US011413346B2

(12) United States Patent
Rauch et al.

(10) Patent No.: US 11,413,346 B2
(45) Date of Patent: Aug. 16, 2022

(54) ROTAVIRUS VACCINES

(71) Applicant: CureVac AG, Tübingen (DE)

(72) Inventors: Susanne Rauch, Tübingen (DE);
Benjamin Petsch, Tübingen (DE)

(73) Assignee: CureVac AG, Tübingen (DE)

( * ) Notice: Subject to any disclaimer, the term of this patent is extended or adjusted under 35 U.S.C. 154(b) by 0 days.

(21) Appl. No.: 15/774,416

(22) PCT Filed: Nov. 9, 2016

(86) PCT No.: PCT/EP2016/077185
§ 371 (c)(1),
(2) Date: May 8, 2018

(87) PCT Pub. No.: WO2017/081110
PCT Pub. Date: May 18, 2017

(65) Prior Publication Data
US 2019/0160164 A1 May 30, 2019

(30) Foreign Application Priority Data
Nov. 9, 2015 (EP) .................................. 15003204

(51) Int. Cl.
*A61K 39/15* (2006.01)
*C12N 15/113* (2010.01)
*A61K 39/12* (2006.01)
*A61P 31/14* (2006.01)
*A61K 9/00* (2006.01)
*C12N 15/62* (2006.01)
*A61K 39/00* (2006.01)

(52) U.S. Cl.
CPC ............ *A61K 39/15* (2013.01); *A61K 9/0019* (2013.01); *A61K 39/12* (2013.01); *A61P 31/14* (2018.01); *C12N 15/113* (2013.01); *C12N 15/62* (2013.01); *A61K 2039/5258* (2013.01); *A61K 2039/53* (2013.01); *C12N 2720/12334* (2013.01)

(58) Field of Classification Search
None
See application file for complete search history.

(56) References Cited

U.S. PATENT DOCUMENTS

| | | |
|---|---|---|
| 2005/0032730 A1 | 2/2005 | Von der Mulbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0156849 A1* | 6/2013 | de Fougerolles ...... A61K 48/00 424/450 |
| 2013/0259879 A1 | 10/2013 | Baumhof et al. |
| 2013/0280283 A1 | 10/2013 | Lorenz et al. |
| 2013/0166609 A1* | 11/2013 | D'Aoust .................. C12N 7/04 |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1 | 2/2015 | Thess |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |

(Continued)

FOREIGN PATENT DOCUMENTS

| | | |
|---|---|---|
| CN | 1624141 | 6/2005 |
| WO | WO 2010/132561 | 11/2010 |

(Continued)

OTHER PUBLICATIONS

Midthun et al. (Journal of Virology, 1985, vol. 53, p. 949-954).*
Patton et al., (Current Pharmaceutical Design, 2004, p. 3769-3777).*
Kovack-Nolan Journal of Biochemistry, 2003, vol. p. 269-275).*
Wen et al. (Vaccine, Jul. 2014, vol. 32, p. 4420-4427).*
Martinon et al. (European Journal of Immunology, 1993, p. 1719-1722) one page only provided.*
Database Uniprot [Online] A0A075BQ08, Rec. Name: Full=Outer capsid protein VP4, Oct. 29, 2014.

(Continued)

*Primary Examiner* — Agnieszka Boesen
(74) *Attorney, Agent, or Firm* — Parker Highlander PLLC

(57) ABSTRACT

The present invention provides mRNA sequences comprising at least one coding region, encoding for at least one epitope of a protein, or of a fragment, variant or derivative thereof, of a virus of the genus rotavirus. Particularly preferred is the protein respectively the protein cleavage product VP8* of rotavirus. The mRNA sequence may be used as a vaccine or generally as a pharmaceutical composition for prophylaxis or treatment of rotavirus infections.

Figure 1:
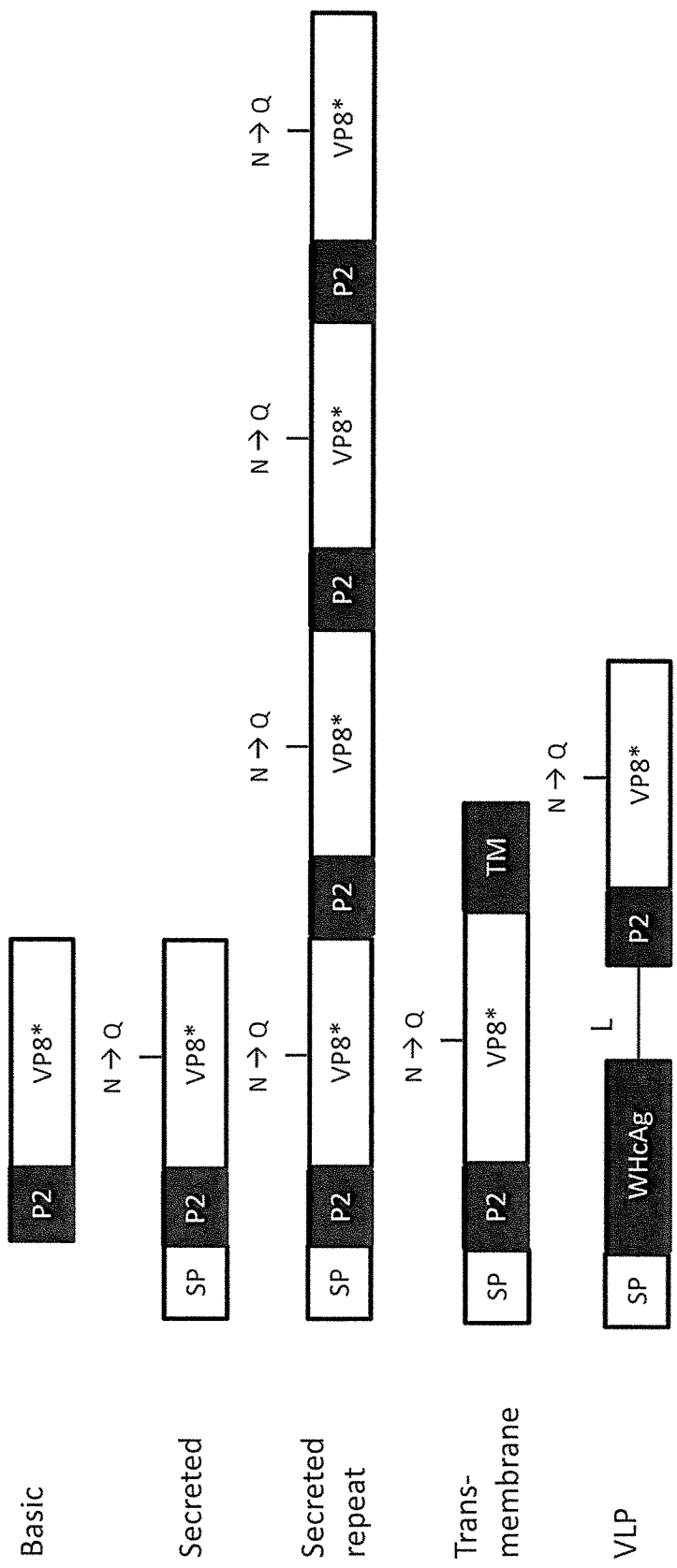

20 Claims, 3 Drawing Sheets
Specification includes a Sequence Listing.

(56) References Cited

U.S. PATENT DOCUMENTS

| | | |
|---|---|---|
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | Von Der Mulbe |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |

FOREIGN PATENT DOCUMENTS

| | | | |
|---|---|---|---|
| WO | WO2010132561 | * 11/2010 | ............. A61K 39/12 |
| WO | WO 2013/120499 | 8/2013 | |
| WO | WO 2015/024668 | 2/2015 | |
| WO | WO 2016/184576 | 11/2016 | |
| WO | WO 2017/021546 | 2/2017 | |
| WO | WO 2017/025447 | 2/2017 | |
| WO | WO 2017/064146 | 4/2017 | |
| WO | WO 2017/109134 | 6/2017 | |
| WO | WO 2017/137095 | 8/2017 | |
| WO | WO 2017/140345 | 8/2017 | |
| WO | WO 2017/140905 | 8/2017 | |
| WO | WO 2017/149139 | 9/2017 | |
| WO | WO 2017/162297 | 9/2017 | |
| WO | WO 2017/182634 | 10/2017 | |
| WO | WO 2017/186928 | 11/2017 | |
| WO | WO 2017/191258 | 11/2017 | |
| WO | WO 2017/191264 | 11/2017 | |
| WO | WO 2017/191274 | 11/2017 | |
| WO | WO 2017/203008 | 11/2017 | |
| WO | WO 2017/212006 | 12/2017 | |
| WO | WO 2017/212007 | 12/2017 | |
| WO | WO 2017/212009 | 12/2017 | |
| WO | WO 2019/008001 | 1/2019 | |

OTHER PUBLICATIONS

International Search Report and Written Opinion issued in corresponding PCT Application No. PCT/EP2016/077185, dated Mar. 14, 2017.

Jere et al., "Whole Genome Analysis of African G2, G8, G9, and G12 Rotavirus Strains Using Sequence-Independent Amplification and 454® Pyrosequencing", *J. Med. Virol.*, 83:2018-2042, 2011.

Lawton et al., "Three-dimensional visualization of mRNA release from actively transcribing rotavirus particles", *Nat. Struct. Biol.*, 4(2):118-121, 1997.

Kallen et al., "A novel, disruptive vaccination technology: Self-adjuvanted RNActive® vaccines", *Hum. Vaccin. Immunother.*, 9(10):2263-2276, 2013.

* cited by examiner

A

B

Figure 2:
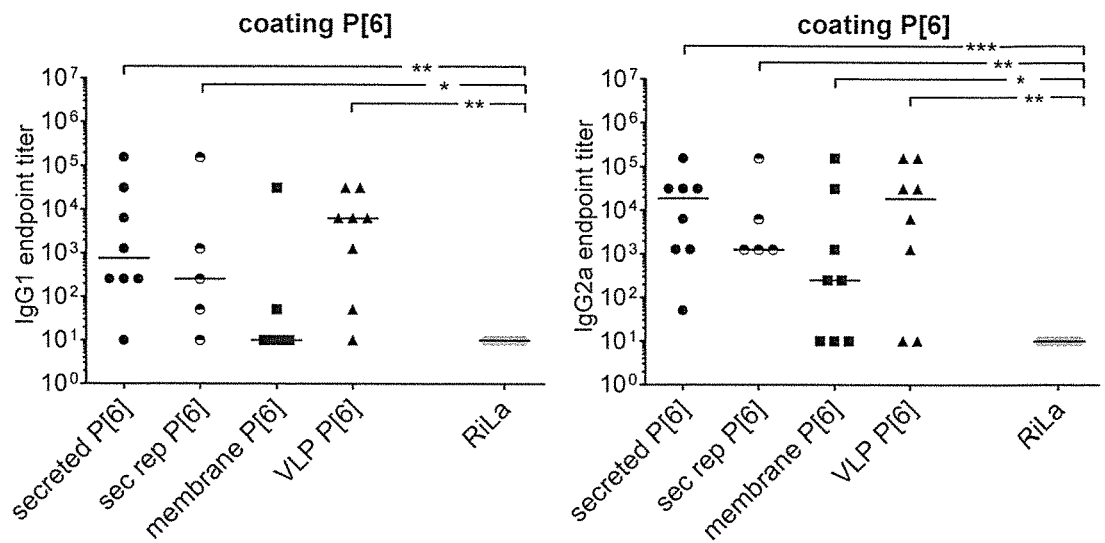
Figure 2:
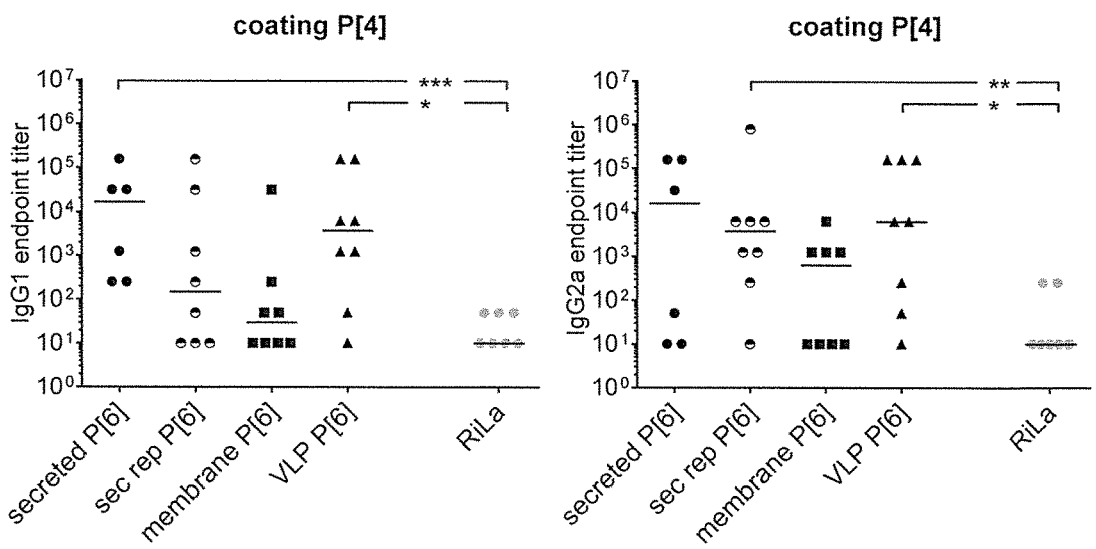

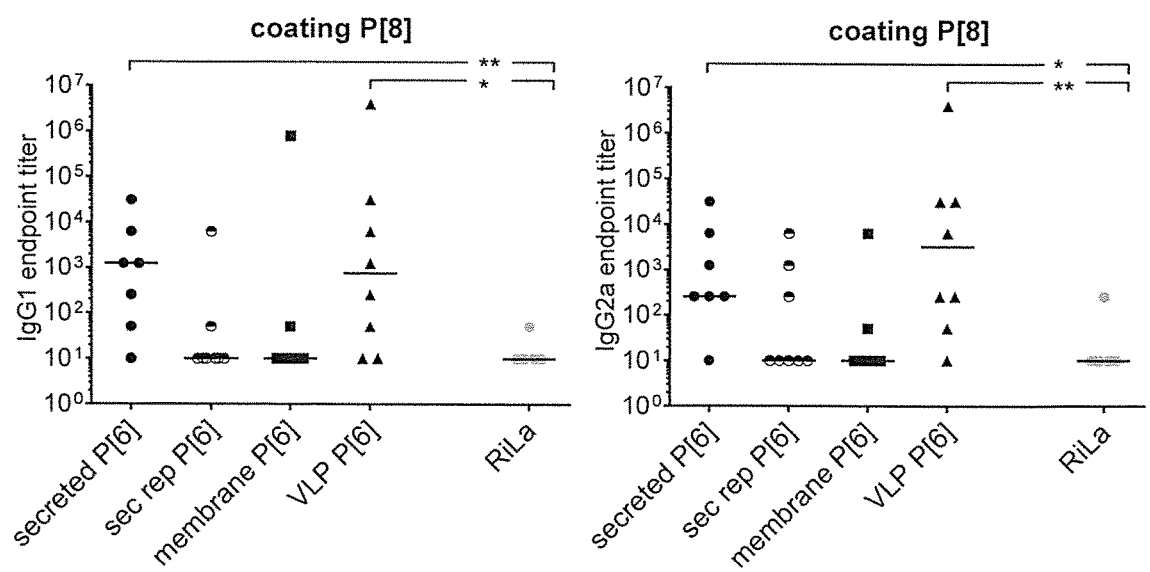
Fig. 2 - continued

ROTAVIRUS VACCINES

This application is a national phase application under 35 U.S.C. § 371 of International Application No. PCT/EP2016/077185, filed Nov. 9, 2016, which claims benefit of European Application No. 15003204.3, filed Nov. 9, 2015, the entire contents of each of which are hereby incorporated by reference.

The present invention relates according to a first aspect to mRNA sequences. According to further aspects the invention relates to compositions, vaccines and kits comprising said mRNA sequences. According to a further aspect of the invention the mRNA sequences may be used for treatment and prophylaxis of rotavirus infections.

Rotavirus infections are the globally leading cause of severe diarrhoea in children younger than five years of age and account for 50% of hospitalisations for childhood diarrhoea. Although rotavirus infections are usually an easily managed disease of childhood, worldwide still more than 450,000 children under five years die from rotavirus infection each year. More than 80% of all rotavirus-related deaths occur in resource-poor countries.

Rotaviruses belong to the family of Reoviridae and have been subdivided into eight species, namely five serological species (rotavirus A to E) and two additional tentative species (rotavirus F and G). These species are commonly referred to as "RV groups". Three species thereof (A, B and C) can infect humans and animals. The other species D, E, F and G have been identified in animals, mostly in birds. Rotavirus A is responsible for more than 90% of all human infections and is most important for human infection and disease. It is transmitted by the faecal-oral route and targets enterocytes in the villi of the small intestine, leading to cell damage and gastroenteritis.

The virus possess a double stranded, segmented RNA genome that encodes six structural and six non-structural proteins and forms non-enveloped particles with three-layered icosaedral capsids. The six structural proteins (VPs—viral proteins) form the virus particle (virion) and are called VP1, VP2, VP3, VP4, VP6 and VP7. The six non-structural proteins (NSPs) are called NSP1, NSP2, NSP3, NSP4, NSP5 and NSP6 and are important for viral mRNA translation, for genome replication, genome encapsidation and capsid assembly. In addition, non-structural proteins are involved in antagonizing the antiviral host response and in subverting important cellular processes to enable successful virus replication.

Within the species rotavirus A, there are different strains (serotypes or genotypes), which are classified by a dual system based on the structural proteins VP7 and VP4. VP7 and VP4 are components of the outermost protein layer (outer capsid), and both carry neutralizing epitopes. VP7 is a glycoprotein (G) that forms the outer layer or surface of the virion. VP7 determines the G-type of the strain. According to Matthijnssens J. et al. (Arch Virol. 2011; 156(8):1397-1413) there are 27 G-serotypes (G1-G27). VP4 is a surface protein that protrudes as a spike. VP4 is essential for virus-cell interaction and determines host range and virulence of the virus. VP4 is protease sensitive (P) and determines the P-type of the virus. There are 35 P-serotypes (P[1]-P[35]). This dual classification system may also be applied to other rotavirus species.

In humans, around 90% of infections are caused by G1, G2, G3 or G4 and also G9 and G12. With respect to the P-types P[4], P[6] and P[8] are the most prevalent, as described by Zeller et al. (Journal of Clinical Microbiology (2012), vol 50, no. 3, pp: 966-976). Importantly, infection with one virus is not able to induce cross-protection against infection by a different serotype.

While the virus is endemic worldwide with almost every child having been infected by the age of five, rotavirus infection is most problematic in the developing world: the majority of deaths occur in Africa and Asia, of which India is the country most heavily affected.

At present, there are two licensed oral vaccines available, which are both based on live-attenuated forms of the virus. RotaTeq® (Merck) is based on a bovine rotavirus strain engineered to express outer layer proteins from human strains. Rotarix® (GlaxoSmithKline) is based on a live-attenuated human rotavirus strain. Both vaccines are given orally and exhibit high efficacy in the developed world. However, the efficacy of oral rotavirus vaccination is significantly reduced in developing countries. This is likely to be caused by several factors. Firstly, the virus-based vaccine can be inactivated by pre-existing antibodies, e.g. transferred to babies by breastfeeding. Secondly, malnutrition can have a negative impact on the efficacy of oral vaccinations. Furthermore, unrelated infections of the gastrointestinal tract which are more prevalent in developing countries compared to developed countries, might be a major factor in reducing vaccine efficacy.

The Chinese patent application CN 102703475 A describes an approach to obtain recombinant bovine rotavirus strains by introducing a recombinant plasmid containing a NSP4 mutant gene resulting in toxicity weakened recombinant bovine rotavirus, which may be used as attenuated vaccine candidate strains.

The U.S. Pat. No. 4,636,385 discloses a method for producing a live rotavirus vaccine against bovine and human rotaviruses by isolation a strain of live bovine rotavirus which does not hemagglutinate primate red blood cells.

The Korean patent application KR 20020061300 A describes the cloning of VP4 and VP7 genes of black goat rotavirus for the purpose of vaccine development.

The Japanese patent application JP 2000139473 A discloses a plant comprising plant cells into which a gene coding for VP6 protein of rotavirus was incorporated. The plant is described to be useful for the production of a vaccine against rotavirus.

Nevertheless, there is a still an urgent need for providing new and improved vaccines, which are particularly important for developing countries. Preferably, the new and improved vaccine should allow parenteral delivery and thus avoid efficacy reduction induced via oral vaccine delivery. Moreover, the new vaccine should allow cost-effective production. Furthermore, especially for the use in developing countries, there is an urgent need for a temperature stabile rotavirus vaccine which is not dependent on cooling (cold chain) for storage and distribution. Furthermore there is an urgent need of a rotavirus vaccine which is effective against different rotavirus serotypes.

This object is solved by the subject matter of the claims. Particularly, the object underlying the present invention is solved according to a first aspect by an mRNA sequence and by a composition as defined in the claims. According to further aspects of the invention the object is solved by a vaccine, a kit and by a method of treatment or prophylaxis of rotavirus infections as defined in the further claims.

For the sake of clarity and readability the following scientific background information and definitions are provided. Any technical features disclosed thereby can be part of each and every embodiment of the invention. Additional definitions and explanations are provided in the context of this disclosure.

Immune system: The immune system may protect organisms from infection. If a pathogen breaks through a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts contains so called humoral and cellular components.

Immune response: An immune response may typically either be a specific reaction of the adaptive immune system to a particular antigen (so called specific or adaptive immune response) or an unspecific reaction of the innate immune system (so called unspecific or innate immune response).

Adaptive immune system: The adaptive immune system is composed of highly specialized, systemic cells and processes that eliminate or prevent pathogenic growth. The adaptive immune response provides the vertebrate immune system with the ability to recognize and remember specific pathogens (to generate immunity), and to mount stronger attacks each time the pathogen is encountered. The system is highly adaptable because of somatic hypermutation (a process of increased frequency of somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of that cell will then inherit genes encoding for the same receptor specificity, including the Memory B cells and Memory T cells that are the keys to long-lived specific immunity. Immune network theory is a theory of how the adaptive immune system works, that is based on interactions between the variable regions of the receptors of T cells, B cells and of molecules made by T cells and B cells that have variable regions.

Adaptive immune response: The adaptive immune response is typically understood to be antigen-specific. Antigen specificity allows for the generation of responses that are tailored to specific antigens, pathogens or pathogen-infected cells. The ability to mount these tailored responses is maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naive T cells are constantly passing. Cell types that can serve as antigen-presenting cells are inter alia dendritic cells, macrophages, and B cells. Each of these cells has a distinct function in eliciting immune responses. Dendritic cells take up antigens by phagocytosis and macropinocytosis and are stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. Presenting the antigen on MHC molecules leads to activation of T cells which induces their proliferation and differentiation into armed effector T cells. The most important function of effector T cells is the killing of infected cells by CD8+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which do not recognize and bind antigen directly, but instead recognize short peptide fragments e.g. of pathogen-derived protein antigens, which are bound to MHC molecules on the surfaces of other cells.

Cellular immunity/cellular immune response: Cellular immunity relates typically to the activation of macrophages, natural killer cells (NK), antigen-specific cytotoxic T-lymphocytes, and the release of various cytokines in response to an antigen. In a more general way, cellular immunity is not related to antibodies but to the activation of cells of the immune system. A cellular immune response is characterized e.g. by activating antigen-specific cytotoxic T-lymphocytes that are able to induce apoptosis in body cells displaying epitopes of an antigen on their surface, such as virus-infected cells, cells with intracellular bacteria, and cancer cells displaying tumor antigens; activating macrophages and natural killer cells, enabling them to destroy pathogens; and stimulating cells to secrete a variety of cytokines that influence the function of other cells involved in adaptive immune responses and innate immune responses.

Humoral immunity/humoral immune response: Humoral immunity refers typically to antibody production and the accessory processes that may accompany it. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Innate immune system: The innate immune system, also known as non-specific immune system, comprises the cells and mechanisms that defend the host from infection by other organisms in a non-specific manner. This means that the cells of the innate system recognize and respond to pathogens in a generic way, but unlike the adaptive immune system, it does not confer long-lasting or protective immunity to the host. The innate immune system may be e.g. activated by ligands of pathogen-associated molecular patterns (PAMP) receptors, e.g. Toll-like receptors (TLRs) or other auxiliary substances such as lipopolysaccharides, TNF-alpha, CD40 ligand, or cytokines, monokines, lymphokines, interleukins or chemokines, immunostimulatory nucleic acids, immunostimulatory RNA (isRNA), CpG-DNA, antibacterial agents, or anti-viral agents. Typically a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system through a process known as antigen presentation; and/or acting as a physical and chemical barrier to infectious agents.

Adjuvant/adjuvant component: An adjuvant or an adjuvant component in the broadest sense is typically a (e.g. pharmacological or immunological) agent or composition that may modify, e.g. enhance, the efficacy of other agents, such as a drug or vaccine. Conventionally the term refers in the context of the invention to a compound or composition that serves as a carrier or auxiliary substance for immunogens and/or other pharmaceutically active compounds. It is to be interpreted in a broad sense and refers to a broad spectrum of substances that are able to increase the immunogenicity of antigens incorporated into or co-administered with an adjuvant in question. In the context of the present invention an adjuvant will preferably enhance the specific immunogenic effect of the active agents of the present invention. Typically, "adjuvant" or "adjuvant component" has the same meaning and can be used mutually. Adjuvants may be divided, e.g., into immuno potentiators, antigenic delivery systems or even combinations thereof. The term "adjuvant" is typically understood not to comprise agents which confer immunity by themselves. An adjuvant assists the immune system unspecifically to enhance the antigen-specific immune response by e.g. promoting presentation of an antigen to the immune system or induction of an unspecific innate immune response. Furthermore, an adjuvant may preferably e.g. modulate the antigen-specific immune response by e.g. shifting the dominating Th2-based antigen specific response to a more Th1-based antigen specific response or vice versa. Accordingly, an adjuvant may favourably modulate cytokine expression/secretion, antigen presentation, type of immune response etc.

Antigen: The term "antigen" refers typically to a substance which may be recognized by the immune system and may be capable of triggering an antigen-specific immune response, e.g. by formation of antibodies or antigen-specific T-cells as part of an adaptive immune response. An antigen may be a protein or peptide. In this context, the first step of an adaptive immune response is the activation of naïve antigen-specific T cells by antigen-presenting cells. This occurs in the lymphoid tissues and organs through which naïve T cells are constantly passing. The three cell types that can serve as antigen-presenting cells are dendritic cells, macrophages, and B cells. Each of these cells has a distinct function in eliciting immune responses. Tissue dendritic cells take up antigens by phagocytosis and macropinocytosis and are stimulated by infection to migrate to the local lymphoid tissue, where they differentiate into mature dendritic cells. Macrophages ingest particulate antigens such as bacteria and are induced by infectious agents to express MHC class II molecules. The unique ability of B cells to bind and internalize soluble protein antigens via their receptors may be important to induce T cells. By presenting the antigen on MHC molecules leads to activation of T cells which induces their proliferation and differentiation into armed effector T cells. The most important function of effector T cells is the killing of infected cells by CD8+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which does not recognize and bind antigen directly, but instead recognize short peptide fragments e.g. of pathogens' protein antigens, which are bound to MHC molecules on the surfaces of other cells.

T cells: T cells fall into two major classes that have different effector functions. The two classes are distinguished by the expression of the cell-surface proteins CD4 and CD8. These two types of T cells differ in the class of MHC molecule that they recognize. There are two classes of MHC molecules—MHC class I and MHC class II molecules—which differ in their structure and expression pattern on tissues of the body. CD4+ T cells bind to a MHC class II molecule and CD8+ T cells to a MHC class I molecule. MHC class I and MHC class II molecules have distinct distributions among cells that reflect the different effector functions of the T cells that recognize them. MHC class I molecules present peptides of cytosolic and nuclear origin e.g. from pathogens, commonly viruses, to CD8+ T cells, which differentiate into cytotoxic T cells that are specialized to kill any cell that they specifically recognize. Almost all cells express MHC class I molecules, although the level of constitutive expression varies from one cell type to the next. But not only pathogenic peptides from viruses are presented by MHC class I molecules, also self-antigens like tumor antigens are presented by them. MHC class I molecules bind peptides from proteins degraded in the cytosol and transported in the endoplasmic reticulum. The CD8+ T cells that recognize MHC class I:peptide complexes at the surface of infected cells are specialized to kill any cells displaying foreign peptides and so rid the body of cells infected with viruses and other cytosolic pathogens. The main function of CD4+ T cells (CD4+ helper T cells) that recognize MHC class II molecules is to activate other effector cells of the immune system. Thus MHC class II molecules are normally found on B lymphocytes, dendritic cells, and macrophages, cells that participate in immune responses, but not on other tissue cells. Macrophages, for example, are activated to kill the intravesicular pathogens they harbour, and B cells to secrete immunoglobulins against foreign molecules. MHC class II molecules are prevented from binding to peptides in the endoplasmic reticulum and thus MHC class II molecules bind peptides from proteins which are degraded in endosomes. They can capture peptides from pathogens that have entered the vesicular system of macrophages, or from antigens internalized by immature dendritic cells or the immunoglobulin receptors of B cells. Pathogens that accumulate in large numbers inside macrophage and dendritic cell vesicles tend to stimulate the differentiation of Th1 cells, whereas extracellular antigens tend to stimulate the production of Th2 cells. Th1 cells activate the microbicidal properties of macrophages and induce B cells to make IgG antibodies that are very effective of opsonising extracellular pathogens for ingestion by phagocytic cells, whereas Th2 cells initiate the humoral response by activating naïve B cells to secrete IgM, and induce the production of weakly opsonising antibodies such as IgG1 and IgG3 (mouse) and IgG2 and IgG4 (human) as well as IgA and IgE (mouse and human).

Epitope (also called "antigen determinant"): An "epitope" is a portion of an antigen that is recognized by the immune system (e.g., by an antibody, an immunoglobulin receptor, a B cell receptor or a T cell receptor). An epitope can be linear or conformational. Commonly, an epitope is a polypeptide or polysaccharide in a naturally occurring antigen. T cell epitopes may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC molecule. B cell epitopes are typically fragments located on the outer surface of (native) protein or peptide antigens. Accordingly, a B-cell epitope is preferably exposed on the surface of the antigen or pathogen, and can be linear or conformational. Normally, a B-cell epitope will include at least about 5 amino acids but can be as small as 3-4 amino acids.

Vaccine: A vaccine is typically understood to be a prophylactic or therapeutic material providing at least one epitope, one antigen or one antigenic function. The epitope, antigen or antigenic function may stimulate the body's adaptive immune system to provide an adaptive immune response.

Antigen-providing mRNA: An antigen-providing mRNA or an epitope-providing mRNA may typically be an mRNA, having at least one open reading frame that can be translated by a cell or an organism provided with that mRNA. The product of this translation is a peptide or protein that may act as an antigen, preferably as an immunogen. The product may also be a fusion protein composed of more than one immunogen, e.g. a fusion protein that consist of two or more epitopes, peptides or proteins, wherein the epitopes, peptides or proteins may be linked by linker sequences.

5'-CAP-Structure: A 5'-CAP is typically a modified nucleotide, particularly a guanine nucleotide, added to the 5' end of an mRNA molecule. Preferably, the 5'-CAP is added using a 5'-5'-triphosphate linkage (also named m7GpppN). Further examples of 5'-CAP structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-CAP structures may be used in the context of the present invention to modify the mRNA sequence. Further modified 5'-CAP structures which may be used in the context of the present invention are CAP1 (methylation of the ribose of the adjacent nucleotide of m7GpppN), CAP2 (methylation of the ribose of the $2^{nd}$ nucleotide downstream of the m7GpppN), CAP3 (methylation of the ribose of the $3^{rd}$ nucleotide downstream of the m7GpppN), CAP4 (methylation of the ribose of the $4^{th}$ nucleotide downstream of the m7GpppN), ARCA (anti-reverse CAP analogue), modified ARCA (e.g. phosphothioate modified ARCA), inosine, N1-methylguanosine, 2'-fluoro-guanosine, 7-deaza-guanosine, 8-oxo-guanosine, 2-amino-guanosine, LNA-guanosine, and 2-azido-guanosine.

Nucleic acid: The term nucleic acid means any DNA or RNA molecule and is used synonymous with polynucleotide. Wherever herein reference is made to a nucleic acid or nucleic acid sequence encoding for a particular protein and/or peptide, said nucleic acid or nucleic acid sequence, respectively, preferably also comprises regulatory sequences allowing in a suitable host, e.g. a human being, its expression, i.e. transcription and/or translation of the nucleic acid sequence encoding for the particular protein or peptide.

Peptide: A peptide is a polymer of amino acid monomers. Usually the monomers are linked by peptide bonds. The term "peptide" does not limit the length of the polymer chain of amino acids. In some embodiments of the present invention a peptide may for example contain less than 50 monomer units. Longer peptides are also called polypeptides, typically having 50 to 600 monomeric units, more specifically 50 to 300 monomeric units.

Pharmaceutically effective amount: A pharmaceutically effective amount in the context of the invention is typically understood to be an amount that is sufficient and/or efficient to induce an immune response.

Protein: A protein typically consists of one or more peptides and/or polypeptides folded into 3-dimensional form, facilitating a biological function.

Poly(C) sequence: A poly(C) sequence is typically a long sequence of cytosine nucleotides, typically about 10 to about 200 cytosine nucleotides, preferably about 10 to about 100 cytosine nucleotides, more preferably about 10 to about 70 cytosine nucleotides or even more, preferably about 20 to about 50, or even about 20 to about 30 cytosine nucleotides. A poly(C) sequence may preferably be located 3' of the coding region comprised by a nucleic acid.

Poly(A) tail: A poly(A) tail also called "3'-poly(A) tail" is typically a long sequence of adenosine nucleotides of up to about 400 adenosine nucleotides, e.g. from about 25 to about 400, preferably from about 50 to about 400, more preferably from about 50 to about 300, even more preferably from about 50 to about 250, most preferably from about 60 to about 250 adenosine nucleotides, added to the 3' end of a RNA.

Stabilized nucleic acid: A stabilized nucleic acid, typically, exhibits a modification increasing resistance to in vivo degradation (e.g. degradation by an exo- or endo-nuclease) and/or ex vivo degradation (e.g. by the manufacturing process prior to vaccine administration, e.g. in the course of the preparation of the vaccine solution to be administered). Stabilization of RNA can, e.g., be achieved by providing a 5'-CAP-Structure, a poly(A) tail, or any other UTR-modification. It can also be achieved by backbone-modification or modification of the G/C content of the nucleic acid. Various other methods are known in the art and conceivable in the context of the invention.

Carrier/polymeric carrier: A carrier in the context of the invention may typically be a compound that facilitates transport and/or complexation of another compound. Said carrier may form a complex with said other compound. A polymeric carrier is a carrier that is formed of a polymer.

Cationic component: The term "cationic component" typically refers to a charged molecule, which is positively charged (cation) at a pH value of typically about 1 to 9, preferably of a pH value of or below 9 (e.g. 5 to 9), of or below 8 (e.g. 5 to 8), of or below 7 (e.g. 5 to 7), most preferably at physiological pH values, e.g. about 7.3 to 7.4. Accordingly, a cationic peptide, protein or polymer according to the present invention is positively charged under physiological conditions, particularly under physiological salt conditions of the cell in vivo. A cationic peptide or protein preferably contains a larger number of cationic amino acids, e.g. a larger number of Arg, His, Lys or Orn than other amino acid residues (in particular more cationic amino acids than anionic amino acid residues like Asp or Glu) or contains blocks predominantly formed by cationic amino acid residues. The definition "cationic" may also refer to "polycationic" components.

3'-untranslated region (3'-UTR): A 3'-UTR is typically the part of an mRNA which is located between the protein coding region (i.e. the open reading frame) and the poly(A) sequence of the mRNA. A 3'-UTR of the mRNA is not translated into an amino acid sequence. The 3'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'-capping, splicing the pre-mature mRNA to excise optional introns and modifications of the 3'-end, such as polyadenylation of the 3'-end of the pre-mature mRNA and optional endo- or exonuclease cleavages etc. In the context of the present invention, a 3'-UTR corresponds to the sequence of a mature mRNA which is located 3' to the stop codon of the protein coding region, preferably immediately 3' to the stop codon of the protein coding region, and which extends to the 5'-side of the poly(A) sequence, preferably to the nucleotide immediately 5' to the poly(A) sequence. The term "corresponds to" means that the 3'-UTR sequence may be an RNA sequence, such as in the mRNA sequence used for defining the 3'-UTR sequence, or a DNA sequence which corresponds to such RNA sequence. In the context of the present invention, the term "a 3'-UTR of a gene", such as "a 3'-UTR of an albumin gene", is the sequence which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence of the 3'-UTR.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites or a 5'-Terminal Oligopyrimidine Tract. The 5'-UTR may be posttranscriptionally modified, for example by addition of a 5'-CAP. In the context of the present invention, a 5'UTR corresponds to the sequence of a mature mRNA which is located between the 5'-CAP and the start codon. Preferably, the 5'-UTR corresponds to the sequence which extends from a nucleotide located 3' to the 5'-CAP, preferably from the nucleotide located immediately 3' to the 5'-CAP, to a nucleotide located 5' to the start codon of the protein coding region, preferably to the nucleotide located immediately 5' to the start codon of the protein coding region. The nucleotide located immediately 3' to the 5'-CAP of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence which corresponds to such RNA sequence. In the context of the present invention, the term "a 5'-UTR of a gene", such as "a 5'-UTR of a TOP gene", is the sequence which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR.

5' Terminal Oligopyrimidine Tract (TOP): The 5' terminal oligopyrimidine tract (TOP) is typically a stretch of pyrimidine nucleotides located at the 5' terminal region of a nucleic acid molecule, such as the 5' terminal region of certain mRNA molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. mRNA that contains a 5' terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5' TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5' end with a cytosine nucleotide. In TOP genes and TOP mRNAs, the TOP-motif preferably starts at its 5' end with the transcriptional start site and ends one nucleotide 5' to the first purine residue in said gene or mRNA. A TOP motif in the sense of the present invention is preferably located at the 5'end of a sequence which represents a 5'-UTR or at the 5' end of a sequence which codes for a 5'-UTR. Thus, preferably, a stretch of 3 or more pyrimidine nucleotides is called "TOP motif" in the sense of the present invention if this stretch is located at the 5' end of a respective sequence, such as the m RNA, the 5'-UTR element of the mRNA, or the nucleic acid sequence which is derived from the 5'-UTR of a TOP gene as described herein. In other words, a stretch of 3 or more pyrimidine nucleotides which is not located at the 5'-end of a 5'-UTR or a 5'-UTR element but anywhere within a 5'-UTR or a 5'-UTR element is preferably not referred to as "TOP motif".

TOP gene: TOP genes are typically characterised by the presence of a 5' terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-CAP to the nucleotide located 5' to the start codon. A 5'-UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID NOs: 1-1363, SEQ ID NO: 1395, SEQ ID NO: 1421 and SEQ ID NO: 1422 of the international patent application WO2013/143700 or homologs or variants thereof, whose disclosure is incorporated herewith by reference. In this context a particularly preferred fragment of a 5'UTR of a TOP gene is a 5'-UTR of a TOP gene lacking the 5' TOP motif. The term "5'UTR of a TOP gene" preferably refers to the 5'-UTR of a naturally occurring TOP gene.

Fragment of a nucleic acid sequence, particularly an mRNA: A fragment of a nucleic acid sequence consists of a continuous stretch of nucleotides corresponding to a continuous stretch of nucleotides in the full-length nucleic acid sequence which is the basis for the nucleic acid sequence of the fragment, which represents at least 20%, preferably at least 30%, more preferably at least 40%, more preferably at least 50%, even more preferably at least 60%, even more preferably at least 70%, even more preferably at least 80%, and most preferably at least 90% of the full-length nucleic acid sequence. Such a fragment, in the sense of the present invention, is preferably a functional fragment of the full-length nucleic acid sequence.

Identity of a sequence: In order to determine the percentage to which two sequences are identical, e.g. nucleic acid sequences or amino acid sequences as defined herein, preferably the amino acid sequences encoded by a nucleic acid sequence as defined herein or the amino acid sequences themselves, the sequences can be aligned in order to be subsequently compared to one another. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program.

Variant of a nucleic acid sequence, particularly an mRNA: A variant of a nucleic acid sequence refers to a variant of nucleic acid sequences which forms the basis of a nucleic acid sequence. For example, a variant nucleic acid sequence may exhibit one or more nucleotide deletions, insertions, additions and/or substitutions compared to the nucleic acid sequence from which the variant is derived. Preferably, a variant of a nucleic acid sequence is at least 40%, preferably at least 50%, more preferably at least 60%, more preferably at least 70%, even more preferably at least 80%, even more preferably at least 90%, most preferably at least 95% identical to the nucleic acid sequence the variant is derived from. Preferably, the variant is a functional variant. A "variant" of a nucleic acid sequence may have at least 70%, 75%, 80%, 85%, 90%, 95%, 98% or 99% nucleotide identity over a stretch of 10, 20, 30, 50, 75 or 100 nucleotide of such nucleic acid sequence.

The mRNA sequence according to the invention comprises at least one coding region, encoding at least one epitope of a protein, or of a fragment, variant or derivative thereof, of a virus of the genus rotavirus. This mRNA sequence may form the basis for an mRNA based vaccine which is a subunit vaccine. Such a subunit vaccine is particularly advantageous in treatment and especially prophylaxis of rotavirus infections. The design as subunit vaccine is especially advantageous since a subunit vaccine is significantly less risky in terms of side effects associated with live vaccines in general. The vaccine based on the inventive mRNA allows parenteral delivery that is not affected by possible efficacy reductions which may occur via the oral route. Generally, protein-based vaccines, as they are known in the prior art, are suboptimal in developing countries due to their high production costs. In contrast, the mRNA-based vaccines according to the present invention allow very cost-effective production. Therefore, in comparison with known vaccines the vaccine based on the inventive mRNA can be produced significantly cheaper, which is very advantageous particularly for use in developing countries. One further advantage of a vaccine based on the inventive mRNA may be its temperature-stable nature in comparison with the life oral rotavirus vaccines available or with other protein or peptide-based vaccine compositions.

Because of these advantages the vaccine based on the present invention may be used especially for widely used prophylaxis or treatment of rotavirus infections particularly in developing countries, where rotavirus infections are a severe problem.

According to the invention the mRNA sequence comprises at least one coding region encoding at least one epitope of a protein or of a fragment, variant or derivative thereof of a virus of the genus rotavirus. In this context the rotavirus species may be selected form the species A, B, C, D, E, F, G or H, wherein it is particularly preferred that the rotavirus is selected from species A or B or C. Species A, B and C are known to infect humans and various animals. In an especially preferred embodiment the selected rotavirus species is rotavirus A (RVA) which is particularly important for human infections.

The rotavirus may be selected from any one of the following G-serotypes and P-serotypes: G1, G2, G3, G4, G5, G6, G7, G8, G9, G10, G11, G12, G13, G14, G15, G16, G17, G18, G19, G20, G21, G22, G23, G24, G25, G26, G27, P[1], P[2], P[3], P[4], P[5], P[6], P[7], P[8], P[9], P[10], P[11], P[12], P[13], P[14], P[15], P[16], P[17], P[18], P[19], P[20], P[21], P[22], P[23], P[24], P[25], P[26], P[27], P[28], P[29], P[30], P[31], P[32], P[33], P[34], or P[35]. In this context the serotypes G1, G2, G3, G4, G9, G12, P[4], P[6] or P[8] are particularly preferred.

Preferably, the inventive mRNA sequence encodes at least one epitope of a protein, or of a fragment, variant or derivative thereof of a virus of the genus rotavirus, which is at least 60% identical, more preferably at least 70% identical, more preferably at least 80% identical, more preferably at least 90% identical, more preferably at least 95% identical, or most preferably at least 99% identical with the wild type protein or fragment thereof, respectively the wild type epitope. The percentage of identities may refer to the identity of amino acid sequences of the protein or to the identity of nucleotide sequences of the mRNA.

The term wild type is to be understood according to the skilled person's general understanding in the art and denotes the protein, the fragment thereof or the epitope in the form of its occurrence in nature without any mutation or amino acid amendment by man. In the context of the invention the term wild type protein corresponds to the protein of the respective isolated rotavirus.

In other embodiments the amino acid sequence of the encoded protein, the fragment thereof or the epitope may be mutated. For example it may be particularly preferred that glycosylation sites in the encoded amino acid sequence are mutated which means that encoded amino acids which may be glycosylated after translation in vivo are exchanged to a different amino acid. Preferably, codons encoding asparagine which are predicted to be glycosylated (N glycosylation sites) are mutated to encode glutamine.

Preferably, the protein of a virus of the genus rotavirus is selected from a structural protein of rotavirus, especially from VP1 (preferably according to SEQ ID NO: 1) or VP2 (preferably according to SEQ ID NO: 2) or VP3 (preferably according to SEQ ID NO: 3) or VP4 (preferably according to SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13 or SEQ ID NO: 14; SEQ ID Nos: 42-44; 46; 48; 5076) or VP6 (preferably according to SEQ ID NO: 15) or VP7 (preferably according to SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25 or SEQ ID NO: 26). Moreover, it is possible, that the protein is selected from a non-structural protein of rotavirus, especially from NSP1 (preferably according to SEQ ID NO: 27) or NSP2 (preferably according to SEQ ID NO: 28) or NSP3 (preferably according to SEQ ID NO: 29) or NSP4 (preferably according to SEQ ID NO: 30, SEQ ID NO: 31, SEQ ID NO: 32, SEQ ID NO: 33, SEQ ID NO:34, SEQ ID NO: 35, SEQ ID NO: 36 or SEQ ID NO: 37) or NSP5 (preferably according to SEQ ID NO: 38) or NSP6 (preferably according to SEQ ID NO: 39).

It is especially preferred that the protein is selected from VP4 or VP7 or a cleavage product of VP4. These proteins are particularly preferred because they are the components of the outermost protein layer of the rotavirus which may be especially relevant for an immune response. In an especially preferred embodiment the protein derives from a cleavage product of VP4, preferably VP5* (preferably according to SEQ ID NO: 40) or VP8* (preferably according to SEQ ID NO: 41, SEQ ID NO: 45, SEQ ID NO: 47 or SEQ ID NO: 49, wherein VP8* is particularly preferred. Although VP5* and VP8* are cleavage products of the protein VP4 they are nevertheless referred to as proteins. Moreover, the proteins VP2, VP6, NSP2 and/or NSP4 may be especially preferred in other embodiments. The amino acid sequences as shown in the sequence listing derive from different rotavirus A strains, in particular from Human rotavirus A Ecu534, Human rotavirus A RVA/Human_wt/VNM/30378/2009/G26P[19], Human rotavirus A RVA/Human-tc/IDN/57M/1980/G4P[10], Human rotavirus A RVA/Human-wt/BEL/BE1058/2008/G2P[4], Human rotavirus A RVA/Human-wt/BEL/BE1128/2009/G1P[8], Human rotavirus A RVA/Vaccine/USA/Rotarix-A41CB052A/1988/G1P1A[8], Human rotavirus A strain CMH222, Human rotavirus A Wa variant VirWa, Human rotavirus HMG035, Lamb rotavirus Lp14, Murine rotavirus EB, Murine rotavirus EHP, Porcine rotavirus A 61/07/Ire, Porcine rotavirus A strain 134/04-15, Porcine rotavirus A34, Porcine rotavirus A46, Rabbit rotavirus 160/01, Rotavirus A 344-04-1, Rotavirus A Ch-02V0002G3, Rotavirus A Ch-06V0661, Rotavirus A FGP51, Rotavirus A Hu/BEL/F01322/2009/G3P[6], Rotavirus A human-wt/ITA/ME848/12/2012/G12P9, Rotavirus A RVA/Cow-wt/ARG/791_BA/1999/G10P[5], Rotavirus A RVA/Cow-wt/ARG/B1191_B_BA/2000/G10P[11], Rotavirus A RVA/Human-TC/USA/Rotarix/2009/G1P[8], Rotavirus A RVA/Human-wt/BEL/B4106/2000/G3P[14], Rotavirus A RVA/Human-wt/Bel/BE00112/2009/G1P[8], Rotavirus A RVA/Human-wt/BGD/Dhaka6/2001/G11P[25], Rotavirus A RVA/Vaccine/USA/RotaTeq-BrB-9/1996/G4P7[5], Rotavirus A RVA/Vaccine/USA/RotaTeq-SC2-9/1992/G2P7[5], Rotavirus A RVA/Vaccine/USA/RotaTeq-W178-8/1992/G3P7[5], Rotavirus A RVA/Vaccine/USA/RotaTeq-W179-4/1992/G6P1A[8], Rotavirus A RVA/Vaccine/USA/RotaTeq-W179-9/1992/G1P7[5], Rotavirus A Tu-03V0001E10, Rotavirus A turkey-tc/GER/03V0002E10/2003/G22P[35], Rotavirus strain TUCH, Bovine rotavirus A AzuK-1, Bovine rotavirus A Dai-10, Bovine rotavirus H1, Bovine Rotavirus Strain Hg18, Bovine rotavirus WC3, Equine rotavirus H2, Equine rotavirus L338. Nevertheless, the proteins may also derive from all other strains with the following Taxonomy ID or taxID: 1699092, 1637496, 1604860, 1560372, 1537146, 1496075, 1481391, 1461314, 1461313, 1461312, 1461311, 1461310, 1461309, 1461308, 1461307, 1461306, 1461305, 1461304, 1461303, 1461302, 1461301, 1461300, 1461299, 1461298, 1461297, 1461296, 1461295, 1461294, 1461293, 1461292, 1461291, 1461290, 1461289, 1461288, 1461287, 1461286, 1461285, 1460005, 1459051, 1459048, 1459047, 1459046, 1459045, 1454907, 1454906, 1454905, 1454904, 1454903, 1454902, 1454901, 1454900, 1454899, 1454898, 1454897, 1454896, 1454895, 1454894, 1454893, 1454892, 1454891, 1454890, 1454889, 1454888, 1454887, 1454886, 1454885, 1454884, 1454883, 1452758, 1452757, 1424309, 1420855, 1417760, 1399970, 1386847, 1349389, 1348384, 1340801, 1337059, 1327767, 1307516, 1307515, 1307514, 1307513, 1307512, 1307511, 1307510, 1307509, 1307508, 1307507, 1307506, 1307505, 1307170, 1307169, 1307168, 1307167, 1307166, 1307165, 1307164, 1307163, 1307162, 1307161, 1304751, 1302703, 1302702, 1302701, 1302700, 1302699, 1302698, 1271535, 1271534, 1265591, 1260938, 1231331, 1211022, 1211021, 1211020, 1211019, 1211018, 1211017, 1211016, 1204231, 1204230, 1193399, 1193398, 1193397, 1193396, 1193395, 1193394, 1193393, 1193392, 1193391, 1193390, 1193389, 1193388, 1193387, 1193386, 1187998, 1187994, 1184798, 1184797, 1184796, 1184795, 1184792, 1184791, 1184790, 1184789, 1184788, 1184787, 1184786, 1184785, 1184784, 1184783, 1184782, 1184781, 1184780, 1184779, 1184778, 1184777, 1184776, 1184775, 1184774, 1184773, 1184772, 1184771, 1184770, 1184769, 1184768, 1182925, 1182528, 1182527, 1182526, 1182525, 1182524, 1182523, 1182522, 1179682, 1179680, 1179678, 1169021, 1169020, 1169019, 1169018, 1169017, 1169016, 1169015, 1169014, 1169013, 1169012, 1169011, 1169010, 1169009, 1169008, 1168279, 1168278, 1168277, 1168276, 1168275, 1168274, 1168273, 1168272, 1168271, 1168270, 1168269, 1168268, 1168267, 1168266, 1168265, 1168264, 1168263, 1168262, 1168261, 1168260, 1168259, 1168258, 1168257, 1168256, 1168255, 1168254, 1168253, 1168252, 1168251, 1168250, 1168249, 1168248, 1168247, 1168246, 1168245, 1159003, 1159002, 1159001, 1159000, 1148771, 1146936, 1146935, 1146934, 1133028, 1133027, 1133026, 1133025, 1133024, 1133023, 1129884, 1129883, 1129882, 1129881, 1129880, 1129879, 1129878, 1129877, 1129876, 1129875, 1129874, 1127364, 1127363, 1127362, 1127361, 1127360, 1127359, 1127358, 1094389, 1094388, 1094387, 1094386, 1092563, 1092562, 1092561, 1077213, 1077212, 1077211, 1077210, 1077209, 1077208, 1074901, 1074900, 1074899, 1074898, 1073965, 1068803, 1056490, 1056489, 1055980, 1052890, 1052889, 1052888, 1049161, 1046565, 1004946, 1004945, 1004944, 1004943, 1004942, 1004941, 1004888, 1004887, 1004886, 1004885, 1004884, 1004883, 1004882, 1004881, 1004880, 1004879, 1004878, 1004877, 1004876, 1004875, 1004874, 1004873, 1004872, 1004871, 1004870, 1004869, 1004868, 1004867, 1004866, 1004865, 1004864, 1004863, 1004862, 1004861, 1004860, 1004859, 1004858, 1004857, 1004856, 1004855, 1004854, 1004853, 1004852, 1004851, 1004850, 1004849, 1004848, 1004847, 1004846, 1004845, 1004844, 1004843, 1004842, 1004841, 1004840, 1004839, 1004838, 1004837, 1004835, 1004834, 1004833, 1004832, 1004831, 1004830, 1004829, 1004828, 1004827, 1004826, 1004825, 1004824, 1004823, 1004822, 1004821, 1004820, 1004819, 1004818, 1004817, 1004816, 1004815, 1004814, 1004813, 1004812, 1004811, 1004810, 1004809, 1004808, 1004807, 1004806, 1004805, 1004804, 1004803, 1004802, 1004801, 1004800, 1004799, 1004798, 1004797, 1004796, 1004795, 1004794, 1004793, 999467, 999466, 994995, 994994, 993362, 984291, 984290, 984289, 984288, 984287, 984286, 984285, 984284, 984283, 981020, 981019, 981018, 981017, 980178, 980177, 980176, 980175, 980174, 980173, 980172, 980094, 980093, 980092, 980091, 980090, 948991, 948990, 948989, 931249, 915344, 910402, 909654, 909653, 909652, 909651, 909650, 909649, 909648, 909647, 909646, 909645, 909644, 909643, 909642, 909641, 909640, 909639, 909638, 909637, 909636, 909635, 909634, 909633, 909632, 909631, 909630, 909629, 905892, 905891, 905890, 905889, 905888, 905887, 905886, 905885, 905884, 905883, 905882, 905881, 905880, 905879, 905878, 905877, 905876, 905875, 905874, 905873, 905872, 905871, 905870, 905869, 905868, 905867, 905866, 905865, 905864, 905863, 905862, 905861, 905860, 905859, 905858, 905857, 905856, 905855, 905854, 905853, 905852, 905851, 905850, 889507, 889506, 889505, 889098, 889097, 889096, 889095, 889091, 889090, 889089, 889087, 889086, 889085, 884200, 882810, 882809, 882808, 882807, 882806, 882805, 882804, 882803, 879654, 879553, 879552, 879551, 879550, 879549, 864624, 864623, 862183, 862182, 862181, 862180, 862179, 862178, 862177, 862176, 862175, 862174, 862173, 862172, 862171, 862170, 862169, 862168, 862167, 861475, 861474, 861473, 861472, 861471, 861470, 861469, 861468, 861467, 861466, 861465, 861464, 861463, 861462, 861461, 861460, 861458, 758915, 758914, 758913, 758912, 758911, 758910, 758909, 758908, 758907, 758906, 758905, 758904, 758903, 758902, 758901, 758900, 758899, 758898, 758897, 758896, 758895, 758894, 758893, 758892, 758891, 758890, 758889, 757426, 757025, 757024, 757023, 757022, 757021, 757020, 757019, 757018, 757017, 757016, 757015, 757014, 757013, 757012, 757011, 757010, 757009, 757008, 757007, 757006, 757005, 757004, 757003, 757002, 757001, 757000, 756999, 756998, 756997, 756996, 756995, 756994, 756993, 756992, 756991, 756990, 756071, 756070, 756069, 756068, 749226, 748551, 748550, 748549, 746014, 743963, 743962, 743959, 743958, 743957, 743956, 743954, 743493, 713948, 713947, 713946, 713945, 713944, 713943, 713942, 713941, 713940, 713939, 713938, 713937, 713936, 713935, 713934, 713933, 713932, 705080, 703409, 697626, 697625, 697624, 697623, 697622, 697621, 697620, 697619, 697618, 697298, 693632, 686194, 686193, 686192, 686191, 686190, 686189, 686188, 686187, 686186, 686185, 686184, 686183, 686182, 686181, 686180, 686179, 686178, 686177, 686176, 686175, 686174, 686173, 686172, 686171, 686170, 686169, 686168, 686167, 686166, 686165, 686164, 686163, 686162, 686161, 686160, 686159, 686158, 686157, 686156, 686155, 686154, 686153, 686152, 686151, 686150, 686149, 686148, 686147, 686146, 686145, 686144, 686143, 686142, 686141, 686140, 686139, 686138, 686137, 686136, 684598, 684597, 684596, 684595, 684594, 679019, 672377, 670792, 670791, 670788, 670787, 670786, 670785, 666970, 666969, 666968, 666967, 666966, 666965, 664658, 664646, 664644, 663259, 663258, 663257, 663256, 663255, 663254, 663253, 663252, 663251, 663250, 663249, 663248, 663247, 663246, 663245, 663244, 662783, 661085, 661084, 661083, 661082, 661081, 661080, 661079, 661078, 661077, 661076, 661075, 661074, 661073, 661072, 661071, 661070, 661069, 661068, 661067, 661066, 661065, 661064, 661063, 661062, 661061, 661060, 661059, 661058, 661057, 661056, 661055, 661054, 661053, 661052, 652664, 652649, 650120, 644773, 641364, 641363, 641362, 641361, 641360, 641359, 641358, 641357, 641356, 641355, 641354, 641353, 641352, 641351, 641350, 641349, 641348, 641347, 641346, 641345, 641344, 641343, 641342, 641341, 641340, 641339, 641338, 641337, 641336, 641335, 641334, 641333, 641332, 641331, 641330, 641329, 641328, 641327, 641326, 641325, 641324, 641323, 641322, 641321, 641320, 641319, 641318, 641317, 641316, 641315, 641314, 641313, 641312, 639281, 639280, 639279, 639278, 639277, 639276, 639275, 639274, 639273, 639272, 639271, 639270, 639269, 639268, 639267, 639266, 639265, 639264, 639263, 639262, 639261, 639260, 639259, 639258, 639257, 639256, 639255, 639254, 639253, 639252, 639251, 639250, 639249, 639248, 639247, 639246, 639245, 639244, 639243, 639242, 638299, 638288, 638287, 638286, 638285, 638284, 638281, 638280, 638279, 638276, 638275, 626776, 626346, 626345, 626344, 587025, 584720, 584719, 578843, 578842, 578841, 578840, 578839, 578838, 578837, 578834, 578832, 578831, 578830, 578829, 578828, 578827, 574986, 574985, 574984, 573023, 573022, 573021, 573020, 573019, 573018, 573017, 573016, 573015, 573014, 573013, 572153, 571650, 571648, 566029, 566028, 561309, 560626, 560613, 557247, 557245, 557243, 557242, 557241, 557232, 556181, 552809, 545676, 531928, 531927, 529839, 529838, 529837, 529836, 529835, 529834, 529833, 529832, 529831, 529830, 529829, 529828, 529827, 526810, 526809, 526808, 526807, 526806, 526805, 526804, 526803, 526802, 526801, 526800, 526799, 526798, 526797, 526796, 526795, 526794, 526793, 526792, 526791, 523819, 523177, 517318, 517317, 517316, 517315, 517314, 517313, 517312, 517311, 517310, 517309, 517308, 517307, 517306, 517305, 517116, 517115, 517114, 517113, 517112, 517111, 517110, 516714, 500141, 500140, 500139, 500138, 500137, 500136, 500135, 500134, 500133, 500132, 500131, 500130, 500129, 500128, 500127, 500126, 500125, 500124, 500123, 500122, 500121, 500120, 500119, 500118, 500117, 500116, 500115, 500114, 500113, 498924, 492519, 492511, 492509, 492508, 492507, 492506, 490299, 490298, 490297, 490296, 490295, 490294, 490293, 490292, 490291, 487340, 487339, 487338, 487337, 487336, 487335, 487334, 487333, 487332, 487331, 487330, 487329, 487328, 487327, 487326, 487325, 487324, 487323, 487322, 487321, 486187, 486186, 481539, 481538, 478084, 471094, 468920, 468919, 468918, 468917, 460769, 458288, 458287, 458286, 458285, 458284, 458283, 458282, 458281, 458280, 458279, 458278, 458277, 458276, 458275, 458274, 458273, 458272, 458271, 458270, 458269, 458267, 450149, 449582, 449126, 444186, 444185, 444184, 429343, 420252, 419438, 418976, 416558, 416557, 408599, 408598, 407261, 407260, 407259, 407258, 407257, 407256, 401627, 401074, 397542, 391897, 380901, 380390, 380389, 375192, 374507, 370535, 370534, 370533, 370532, 370531, 370529, 359942, 356494, 348136, 335103, 335102, 335100, 334591, 308425, 308418, 295016, 293396, 292226, 290547, 290544, 290543, 290542, 290541, 290255, 290254, 285424, 285423, 285422, 285421, 285420, 285419, 285418, 285262, 285002, 273497, 263599, 263598, 263596, 263595, 240592, 238845, 237917, 215680, 204932, 204519, 200686, 200685, 200684, 199305, 199304, 199303, 195702, 195701, 195700, 195481, 195480, 195478, 195477, 195476, 195475, 183407, 183405, 183403, 180231, 173527, 171615, 161240, 161239, 148357, 141270, 141265, 139395, 121794, 111609, 107263, 106517, 106330, 105506, 105505, 105503, 105502, 104626, 104625, 104624, 101363, 101362, 101361, 101360, 101359, 101358, 101357, 101355, 101353, 101352, 101351, 101350, 96046, 94432, 80340, 79955, 79954, 79953, 79952, 79951, 79732, 79694, 79065, 79064, 76592, 76591, 76590, 75918, 73036, 73034, 72140, 72139, 72138, 72137, 72136, 72135, 72134, 72133, 72132, 71031, 70865, 69831, 61856, 57726, 57202, 53982, 53981, 53980, 53979, 53978, 53977, 53976, 53975, 53974, 53965, 53964, 53963, 49892, 48539, 45408, 44572, 42567, 39013, 39012, 39011, 39010, 39009, 37324, 37137, 37136, 36443, 36442, 36441, 36440, 36439, 36437, 36436, 36435, 36434, 36433, 36432, 36427, 35337, 35336, 35334, 35333, 33723, 33722, 31590, 31589, 31588, 31587, 31586, 31583, 31581, 31580, 31579, 31578, 31577, 31574, 31571, 31570, 31569, 31568, 31567, 31566, 31565, 31564, 31563, 28877, 28876, 28875, 28327, 28326, 12705, 12584, 12578, 10978, 10971, 10970, 10969, 10968, 10967, 10963, 10962, 10961, 10960, 10959, 10958, 10957, 10956, 10955, 10954, 10953, 10952, 10951, 10950, 10949, 10948, 10947, 10946, 10944, 10943, 10942, 10941, 10939, 10937, 10935, 10934, 10933, 10931, 10930, 10929, 10928, 10927, 10926, 10925, 10923, 10922, 10921, 10919, 10918, 10917, 10916, 10915, 10913, 10912. 10912.

A Taxonimy ID or taxID is a stable unique identifier for each taxon (for a species, a family, an order, or any other group in the taxonomy database). The taxID is seen in the GenBank records as a "source" feature table entry; for example, /db_xref="taxon:<9606>" is the taxID for *Homo sapiens*, and the line is therefore found in all recent human sequence records).

In the context of the invention additionally to the here disclosed amino acid sequences according to SEQ ID NO: 1-827 also amino acid sequences of different rotavirus strains or rotavirus isolates can be used according to the invention and are incorporated herewith. These different rotavirus isolates show preferably an identity of at least 70%, more preferably of at least 80% and most preferably of at least 90% with the amino acid sequences according to SEQ ID NO: 1-827.

The invention relates to mRNA sequences encoding at least one epitope of a protein as mentioned above, but also of a fragment, variant of derivative thereof. The terms "fragment", "variant" and "derivative" should be understood as follows:

Fragments of proteins: "Fragments" of proteins (or peptides) in the context of the present invention may, typically, comprise a sequence of a protein or peptide as defined herein, which is, with regard to its amino acid sequence (or its encoded nucleic acid molecule), N-terminally and/or C-terminally truncated compared to the amino acid sequence of the original (native) protein (or its encoded nucleic acid molecule). Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide. For example such fragment may have a length of about 6 to about 20 or even more amino acids, e.g. fragments as processed and presented by MHC class I molecules, preferably having a length of about 8 to about 10 amino acids, e.g. 8, 9, or 10, (or even 6, 7, 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T-cells in form of a complex consisting of the peptide fragment and an MHC molecule, i.e. the fragments are typically not recognized in their native form. Fragments of proteins or peptides may comprise at least one epitope of those proteins or peptides. Furthermore also domains of a protein, like the extracellular domain, the intracellular domain or the transmembrane domain and shortened or truncated versions of a protein may be understood to comprise a fragment of a protein.

Variants of proteins: "Variants" of proteins (or peptides) as defined in the context of the present invention may be generated, having an amino acid sequence which differs from the original sequence in one or more mutation(s), such as one or more substituted, inserted and/or deleted amino acid(s). Preferably, these fragments and/or variants have the same biological function or specific activity compared to the full-length native protein, e.g. its specific antigenic property. "Variants" of proteins or peptides as defined in the context of the present invention may comprise conservative amino acid substitution(s) compared to their native, i.e. non-mutated physiological, sequence. Those amino acid sequences as well as their encoding nucleotide sequences in particular fall under the term variants as defined herein. Substitutions in which amino acids, which originate from the same class, are exchanged for one another are called conservative substitutions. In particular, these are amino acids having aliphatic side chains, positively or negatively charged side chains, aromatic groups in the side chains or amino acids, the side chains of which can enter into hydrogen bridges, e.g. side chains which have a hydroxyl function. This means that e.g. an amino acid having a polar side chain is replaced by another amino acid having a likewise polar side chain, or, for example, an amino acid characterized by a hydrophobic side chain is substituted by another amino acid having a likewise hydrophobic side chain (e.g. serine (threonine) by threonine (serine) or leucine (isoleucine) by isoleucine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra) (Urry, 1985, Absorption, Circular Dichroism and ORD of Polypeptides, in: Modern Physical Methods in Biochemistry, Neuberger et al. (ed.), Elsevier, Amsterdam). A "variant" of a protein or peptide may have at least 70%, 75%, 80%, 85%, 90%, 95%, 98% or 99% amino acid identity over a stretch of 10, 20, 30, 50, 75 or 100 amino acids of such protein or peptide. Furthermore, variants of proteins or peptides as defined herein, which may be encoded by a nucleic acid molecule, may also comprise those sequences, wherein nucleotides of the encoding nucleic acid sequence are exchanged according to the degeneration of the genetic code, without leading to an alteration of the respective amino acid sequence of the protein or peptide, i.e. the amino acid sequence or at least part thereof may not differ from the original sequence within the above meaning.

Derivatives of a protein: A derivative of a protein (or peptide) is typically understood to be a molecule that is derived from another molecule, such as said peptide or protein. A "derivative" of a peptide or protein also encompasses fusions comprising a peptide or protein used in the present invention. For example, the fusion comprises a label, such as, for example, an epitope, e.g., a FLAG epitope or a V5 epitope. For example, the epitope is a FLAG epitope. Such a tag is useful for, for example, purifying the fusion protein.

In the following the term "rotavirus protein" is used. This term has to be understood to relate to rotavirus proteins as mentioned above but also to fragments, variants or derivatives thereof.

VP8* is a protein (or protein cleavage product) that is generated upon naturally occurring proteolytic cleavage of the viral cell surface protein VP4 to VP5* and VP8*. VP4 is one of two rotavirus proteins present on the outermost layer of the virus and forms trimeric spikes on the viral surface. A variety of studies employing VP8* as a protein vaccine have shown its ability to induce neutralising antibodies against rotaviruses in mice and guinea pigs (Larralde G et al., J Virol. 1991, 65(6):3213-3218; Dunn S J et al, Arch Virol. 1995; 140(11):1969-1978; Gil M T et al, Viral Immunol. 2000; 13(2):187-200; Perez Filgueira D M et al, Arch Virol. 2004, 149(12):2337-2348; Wen et al, Vaccine. 2012, 30(43):6121-6126) as well as in gnotobiotic pigs (Wen et al, Vaccine. 2014 Jul. 31; 32(35):4420-4427). Now, the inventors were able to demonstrate, that an mRNA-based subunit vaccine comprising a coding region encoding for at least one epitope of especially VP8* is particularly effective in inducing antigen-specific immune responses against rotavirus.

The at least one epitope of a protein or of a fragment, variant or derivative thereof of a virus of the genus rotavirus is preferably derived from one of the serotypes of rotavirus A. For example, the protein VP4 or the protein cleavage product VP5* or especially VP8* may preferably be derived from one of the serotypes P[1]-P[35] (preferably a protein sequence according to any of SEQ ID NOs: 40-76 is chosen). Preferably, the protein VP4 or the protein cleavage product VP5* or especially VP8* is selected from one of the serotypes P[4] or P[6] or P[8], most preferably a protein sequence according to any of SEQ ID Nos: 41; 45; 47; or 49 is chosen. The protein VP7 is preferably selected from one of the serotypes G1 or G2 or G3 or G4 or G9 or G12, most preferably a protein sequence according to any of SEQ ID Nos. 1-26 is chosen.

In this context VP8* is particularly preferred, wherein the inventive mRNA sequence encodes the VP8* protein, preferably the wild type VP8* protein, or a fragment, variant or derivative thereof, which preferably derives from the serotypes P[4] (preferably according to SEQ ID NO: 45) or P[6] (preferably according to SEQ ID NO: 47) or P[8] (preferably according to SEQ ID NO: 41 or SEQ ID NO: 49) of rotavirus A as will be outlined in more detail below. The term wild type is to be understood according to the skilled person's general understanding in the art and denotes the protein in the form of its occurrence in nature without any mutation or amino acid amendment by man. The serotypes P[4] and P[6] and P[8] are the most prevalent P-serotypes important for rotavirus infections and are especially effective in the inventive approach.

In the following the term "VP8* coding region" is used. This term is to be understood that the coding region may encode complete (full-length) VP8*, or a fragment, variant or derivative thereof, also considering the possible percentage of identity of the amino acid sequences (or nucleotide sequences) as outlined above.

Preferably, the amino acid sequence of VP8* derived from serotype P[4] according to SEQ ID NO: 45 (derived from Human rotavirus A RVA/Human-wt/BEL/BE1058/2008/G2P[4]; JN849123.1; GI:371455744) may serve as a basis for advantageous designs of the inventive mRNA sequence.

Preferably, the amino acid sequence of VP8* derived from serotype P[6] according to SEQ ID NO: 47 (derived from Rotavirus A Hu/BEL/F01322/2009/G3P[6]; JF460826.1; GI:37531451) may serve as a basis for advantageous designs of the inventive mRNA sequence.

Preferably, the amino acid sequence of VP8* derived from serotype P[8] according to SEQ ID NO: 41 (derived from Human rotavirus A RVA/Human-wt/BEL/BE1128/2009/G1P[8]; JN849135.1; GI:371455756) may serve as a basis for advantageous designs of the inventive mRNA sequence.

Preferably, the amino acid sequence of VP8* derived from serotype P[8] according to SEQ ID NO: 49 (derived from Human rotavirus A Wa variant VirWa; ACR22783.1) may serve as a basis for advantageous designs of the inventive mRNA sequence.

Preferably, the inventive mRNA sequence encodes an amino acid sequence which is at least 60% identical, more preferably at least 70% identical, more preferably at least 80% identical, more preferably at least 90% identical, more preferably at least 95% identical, or most preferably at least 99% identical to the sequence according to SEQ ID NO: 41 or 45 or 47 or 49.

Preferred protein designs of VP8* for protein-based vaccines represent a shortened form of VP8* that facilitates protein isolation from producer cells (usually bacterial cells), since the full length protein is insoluble in the bacterial expression system. Given that conditions for cytoplasmatic expression in bacteria are not directly transferable to expression and export via the secretory pathway in eukaryotic cells, current mRNA designs feature full length VP8* due to the presence of predicted T-cell epitopes in fragments removed in a shortened form of VP8*. Therefore, according to a preferred embodiment of the inventive mRNA sequence the full length VP8* is encoded. Nevertheless, it may also be preferred to apply a shortened form of VP8* for the inventive mRNA sequence.

In particularly preferred embodiments the inventive mRNA sequence encodes the following shortened forms of VP8*: amino acids (aa) 2-240; 2-230; 11-223; 11-240, 21-240; 4-223; 65-223 or 64-223. Particularly preferred in this context are the amino acid sequences as shown in Table 1.

TABLE 1 amino acid sequences

| Amino acids of VP8* | Serotyp P[4] | Serotyp P[6] | Serotyp P[8] |
|---|---|---|---|
| 2-240 | SEQ ID NO. 77 | SEQ ID NO. 78 | SEQ ID Nos. 79-80 |
| 2-230 | SEQ ID NO. 173 | SEQ ID NO. 174 | SEQ ID NOs. 175-176 |
| 11-223 | SEQ ID NO. 269 | SEQ ID NO. 270 | SEQ ID NOs. 271-272 |
| 11-240 | SEQ ID NO. 365 | SEQ ID NO. 366 | SEQ ID Nos 367-368 |
| 21-240 | SEQ ID NO. 461 | SEQ ID NO. 462 | SEQ ID NOs. 463-464 |
| 41-223 | SEQ ID NO. 557 | SEQ ID NO. 558 | SEQ ID NOs. 559-560 |
| 65-223 | SEQ ID NO. 653 | SEQ ID NO. 654 | SEQ ID Nos. 655-656 |
| 64-223 | SEQ ID NO. 749 | SEQ ID NO. 750 | |

Preferably, the inventive mRNA sequence encodes at least one amino acid sequence which is at least 60% identical, more preferably at least 70% identical, more preferably at least 80% identical, more preferably at least 90% identical, more preferably at least 95% identical, or most preferably at least 99% identical to any of the amino acid sequences as shown in Table 1 or to a respective fragment thereof.

It is possible to apply the unmodified coding sequences to the inventive mRNA sequences. For example, unmodified nucleotide sequences encoding the VP8* are shown in Table 2 Column A respectively.

Nevertheless, in especially preferred embodiments of the invention optimized and modified nucleotide sequences are used as will be outlined in more detail below.

In preferred embodiments of the invention the G/C content of the coding region of the mRNA sequence is increased compared to the G/C content of the coding region of its particular wild type coding sequence, i.e. the unmodified mRNA. For example, coding regions with an increased G/C content encoding VP8* are shown in Table 2 Column B respectively.

In especially preferred designs the inventive mRNA sequence comprises UTRs e.g. as 5'-UTR a 5'-UTR derived from 32L TOP UTR (according to SEQ ID NO. 3189), as 3'-UTR a 3'-UTR derived from human albumin 3'-UTR (according to SEQ ID NO. 3205), a histone stem-loop (according to SEQ ID NO. 3207), a poly(A) sequence, and a poly(C) sequence. Respective mRNA sequences are shown in Table 2 Column D. Alternatively the inventive mRNA sequence comprises a 3'-UTR derived from alpha globin 3'-UTR (according to SEQ ID NO. 3199), a histone stem-loop (according to SEQ ID NO. 3207), a poly(A) sequence, and a poly(C) sequence. Respective mRNA sequences are shown in Table 2 Column C.

TABLE 2 inventive mRNA sequences encoding VP8*

| Amino acids of VP8* | Serotyp P[4] SEQ ID NO(s) | | | | Serotyp P[6] SEQ ID NO(s) | | | | Serotyp P[8] SEQ ID NO(s) | | | |
|---|---|---|---|---|---|---|---|---|---|---|---|---|
| | A | B | C | D | A | B | C | D | A | B | C | D |
| 1-240 | 828 | 878 | 1626 | 2386 | 829 | 879 | 1627 | 2387 | 830-831 | 880-881 | 1628-1629 | 2388-2389 |
| 1-230 | | 974 | 1722 | 2482 | | 975 | 1723 | 2483 | | 976-977 | 1724-1725 | 2484-2485 |
| 11-223 | | 1070 | 1818 | 2578 | | 1071 | 1819 | 2579 | | 1072-1073 | 1820-1821 | 2580-2581 |
| 11-240 | | 1166 | 1914 | 2674 | | 1167 | 1915 | 2675 | | 1168-1169 | 1916-1917 | 2676-2677 |
| 21-240 | | 1262 | 2010 | 2770 | | 1263 | 2011 | 2771 | | 1264-1265 | 2012-2013 | 2772-2773 |
| 41-223 | | 1358 | 2106 | 2866 | | 1359 | 2107 | 2867 | | 1360-1361 | 2108-2109 | 2868-2869 |
| 65-223 | 833 | 1454 | 2202 | 2962 | 835 | 1455 | 2203 | 2963 | 836-837 | 1456-1457 | 2204-2205 | 2964-2965 |
| 64-223 | 832 | 1550 | 2298 | 3058 | 834 | 1551 | 2298 | 3059 | | | | |

Column A = SEQ ID Nos. regarding wild type CDS (coding sequences)

Column B = SEQ ID Nos. regarding CDS (coding sequences) with an increased G/C content Column C = SEQ ID Nos. regarding mRNA sequences comprising a CDS with an increased G/C content and comprising a 3'-UTR derived from alpha globin (according to SEQ ID No. 3199), a histon stem-loop sequence (according to SEQ ID No. 3207) and a poly(A) sequence and a poly(C) sequence.

Column D = SEQ ID Nos. regarding mRNA sequences comprising a CDS with an increased G/C content and comprising a 5'-UTR derived from 32L TOP UTR (according to SEQ ID NO. 3189), a 3'-UTR derived from albumin 3'-UTR (according to SEQ ID No. 3205), a histon stem-loop sequence (according to SEQ ID No. 3207) and a poly(A) sequence and a poly(C) sequence.

Preferably, the inventive mRNA sequence comprises or consists of a nucleotide sequence as shown in Table 2 or which is at least 60% identical, more preferably at least 70% identical, more preferably at least 80% identical, more preferably at least 85%, more preferably at least 90% identical, more preferably at least 95% identical, or most preferably at least 99% identical to any of the sequences shown in Table 2.

Using mRNA as a basis poses challenges concerning antigen localisation that differ from a protein-based approach. During the viral life cycle, VP4 is produced in the cytoplasm and associates with the assembling viral particle on the cytoplasmatic side of the endoplasmatic reticulum (ER) membrane. In a process mediated by a viral accessory protein, the complex then buds into the ER, allowing assembly with the ER resident glycoprotein VP7. In polarised cells, the virus then leaves the infected cell via the secretory pathway (reviewed on Trask et al, Nat Rev Microbiol. 2012 Jan. 23; 10(3):165-177) and is activated by cleavage of VP4 into VP5* and VP8* by trypsin-like proteases in the intestinal lumen. Hence, mRNA-based expression of unmodified VP8* in the absence of additional viral proteins may result in translation of the nascent protein in the cytoplasm of the producing cell, rendering the antigen caught inside the cell. In such a scenario, the antigen as a protein would be inaccessible to the immune system unless the producing cell undergoes cell death. Anyway this might be sufficient to induce an immune response.

Nevertheless, in preferred embodiments of the inventive mRNA sequence, the mRNA sequence encoding at least one epitope of a rotavirus protein or a fragment, variant or derivative thereof, particularly VP8* or a fragment, variant or derivative thereof, is artificially modified and amended, thereby enhancing the immune responses.

In an especially preferred embodiment of the inventive mRNA sequence the mRNA sequence encoding at least one epitope of a rotavirus protein or a fragment, variant or derivative thereof, particularly VP8* or a fragment, variant or derivative thereof, is combined with at least one sequence section encoding a helper peptide for enhancement of immunogenicity. In preferred embodiments the helper peptide is located at the 5'-end of the coding region, encoding the at least one epitope of a rotavirus protein or a fragment, variant or derivative thereof. Preferably, the helper peptide is derived from Tetanus toxin, or a fragment, variant or derivative thereof. By addition of an mRNA sequence encoding such a peptide it is possible to increase immune responses. In the context of a protein-based approach it has already been shown by Wen et al. (Vaccine. 2014 Jul. 31; 32(35): 4420-4427) that the N-terminal P2 helper peptide derived from tetanus toxin was able to increase immune responses against VP8*. Now, the inventors were able to show that the addition of a sequence encoding a helper peptide may be particularly effective in enhancing the immune response in an mRNA-based vaccine approach.

Preferably, the amino acid sequence of P2 helper peptide of tetanus toxin according to SEQ ID NO: 3147 (GenBank X04436 derived from Kovacs-Nolan et al.; PMID 16978788; P2: aa 830-844) may serve as a basis for advantageous designs of the inventive mRNA sequence.

If the sequence section encoding the rotavirus protein is combined with a sequence section encoding a helper peptide at the 5'-end of the sequence section encoding the rotavirus protein a peptide linker may optionally separate the rotavirus protein from the helper peptide.

Preferably, the sequence section encoding the peptide linker is coding for a flexible or a rigid linker.

Flexible linkers are especially preferred, wherein joined domains allow a certain degree of movement or interaction. They are preferably composed of small, non-polar (e.g. Gly) or polar (e.g. Ser or Thr) amino acids. The small size of these amino acids provides flexibility, and allows for mobility of the connecting functional domains, as described by Chen et al. (Adv Drug Deliv Reb. 2013; 65(10):1357-1369). The incorporation of Ser or Thr can maintain the stability of the linker in aqueous solutions by forming hydrogen bonds with the water molecules, and therefore reduces an interaction between the linker and the protein moieties. Rigid linkers generally maintain the distance between the protein domains and they may be based on helical structures and/or they have a sequence that is rich in proline.

A typical sequence of a flexible linker is composed of repeats of the amino acids Glycine and Serine. For instance, the linker may have the following sequence: GS, GSG, SGG. In some embodiments, the same sequence is repeated multiple times (e.g. two, three, four, five or six times) to create a longer linker. In other embodiments, a single amino acid such as S or G can be used as a linker.

Preferably, the sequence section encoding the peptide linker codes for a flexible linker comprising sequences consisting of at least one stretch of glycine and/or serine residues. The term "stretch" describes a sequence of consecutive identical amino acids. More preferably, the flexible linker comprises more than one stretch of glycine and/or serine residues. Advantageously, the stretch or stretches consist(s) of four and/or five amino acids.

Preferably, the amino acid sequences of the peptide linker according to SEQ ID NO: 3174 (derived from publication: PMID 16227284) or SEQ ID NOs: 3175-3176 may serve as a basis for advantageous designs of the inventive mRNA sequence.

Preferred amino acid sequences comprising P2 helper peptide, optionally a peptide linker and VP8* proteins (full-length and shortened forms) are shown in Table 3:

TABLE 3 amino acid sequences for VP8* additionally comprising the P2 helper peptide and optionally a peptide linker

| Amino acids of VP8* | Serotyp P[4] | Serotyp P[6] | Serotyp P[8] |
| --- | --- | --- | --- |
| 2-240 | SEQ ID NO. 81, 797 | SEQ ID NO. 82, 798 | SEQ ID Nos. 83-84, 799 |
| 2-230 | SEQ ID NO. 177 | SEQ ID NO. 178 | SEQ ID NOs. 179-180 |
| 11-223 | SEQ ID NO. 273 | SEQ ID NO. 274 | SEQ ID NOs. 275-276 |
| 11-240 | SEQ ID NO. 369 | SEQ ID NO. 370 | SEQ ID Nos 371-372 |
| 21-240 | SEQ ID NO. 465 | SEQ ID NO. 466 | SEQ ID NOs. 467-468 |
| 41-223 | SEQ ID NO. 561 | SEQ ID NO. 562 | SEQ ID NOs. 563-564 |
| 65-223 | SEQ ID NO. 657 | SEQ ID NO. 658 | SEQ ID Nos. 559-660, 802-803 |
| 64-223 | SEQ ID NO. 751, 800 | SEQ ID NO. 752, 801 | |

Preferably, the inventive mRNA sequence encodes at least one amino acid sequence which is at least 60% identical, more preferably at least 70% identical, more preferably at least 80% identical, more preferably at least 90% identical, more preferably at least 95% identical, or most preferably at least 99% identical to any of the amino acid sequences as shown in Table 3 or to a respective fragment thereof.

Additionally to the amino acid sequences in Table 3 also the inventive mRNA sequences encoding the respective amino acid sequences are disclosed. In this context it is possible to apply unmodified nucleotide sequences or mRNA sequences wherein the G/C content of the coding region is increased compared to the G/C content of the coding region of its particular wild type coding sequence, i.e. the unmodified mRNA. Furthermore, mRNA sequences additionally comprising UTR sequences are disclosed in Table 4.

In especially preferred designs the inventive mRNA sequence comprises UTRs e.g. as 5'-UTR a 5'-UTR derived from 32L TOP UTR (according to SEQ ID NO. 3189), as 3'-UTR a 3'-UTR derived from human albumin 3'-UTR (according to SEQ ID NO. 3205), a histone stem-loop (according to SEQ ID NO. 3207), a poly(A) sequence, and a poly(C) sequence. Respective mRNA sequences are shown in Table 4 Column D. Alternatively the inventive mRNA sequence comprises a 3'-UTR derived from alpha globin 3'-UTR (according to SEQ ID NO. 3199), a histone stem-loop (according to SEQ ID NO. 3207), a poly(A) sequence, and a poly(C) sequence. Respective mRNA sequences are shown in Table 4 Column C.

TABLE 4 mRNA sequences encoding VP8* and additionally encoding the P2 helper peptide and optionally a peptide linker

| Amino acids of VP8* | Serotyp P[4] SEQ ID NO(s) | | | | Serotyp P[6] SEQ ID NO(s) | | | | Serotyp P[8] SEQ ID NO(s) | | | |
|---|---|---|---|---|---|---|---|---|---|---|---|---|
| | A | B | C | D | A | B | C | D | A | B | C | D |
| 1-240 | 838 | 882 1598 | 2346 1630 | 2390 | 839 | 883 1599 | 2347 1631 | 2391 | 840 | 884- 885 1600 | 2348; 1632- 1633 | 2392- 2393 |
| 1-230 | | 978 | 1726 | 2486 | | 979 | 1727 | 2487 | | 980- 981 | 1728- 1729 | 2488- 2489 |
| 11-223 | | 1074 | 1822 | 2582 | | 1075 | 1823 | 2583 | | 1076- 1077 | 1824- 1825 | 2584- 2585 |
| 11-240 | | 1170 | 1918 | 2678 | | 1171 | 1919 | 2679 | | 1172- 1173 | 1920- 1921 | 2680- 2681 |
| 21-240 | | 1266 | 2014 | 2774 | | 1267 | 2015 | 2775 | | 1268- 1269 | 2016- 2017 | 2776- 2777 |
| 41-223 | | 1362 | 2110 | 2870 | | 1363 | 2111 | 2871 | | 1364- 1365 | 2112- 2113 | 2872- 2873 |
| 65-223 | | 1458 | 2206 | 2966 | | 1459 | 2207 | 2967 | 843- 844 | 1460- 1461; 1603- 1604 | 2351- 2352; 2208- 2209 | 2968- 2969 |
| 64-223 | 841 | 1552 1601 | 2349 2300 | 3060 | 842 | 1553 1602 | 2350 2301 | 3061 | | | | |

Column A = SEQ ID Nos. regarding wild type CDS (coding sequences)

Column B = SEQ ID Nos. regarding CDS (coding sequences) with an increased G/C content Column C = SEQ ID Nos. regarding mRNA sequences comprising a CDS with an increased G/C content and comprising a 3'-UTR derived from alpha globin (according to SEQ ID No. 3199), a histon stem-loop sequence (according to SEQ ID No. 3207) and a poly(A) sequence and a poly(C) sequence.

Column D = SEQ ID Nos. regarding mRNA sequences comprising a CDS with an increased G/C content and comprising a 5'-UTR derived from 32L TOP UTR (according to SEQ ID NO. 3189), a 3'-UTR derived from albumin 3'-UTR (according to SEQ ID No. 3205), a histon stem-loop sequence (according to SEQ ID No. 3207) and a poly(A) sequence and a poly(C) sequence.

Preferably, the inventive mRNA sequence comprises or consists of a nucleotide sequence as shown in Table 4 or which is at least 60% identical, more preferably at least 70% identical, more preferably at least 80% identical, more preferably at least 85%, more preferably at least 90% identical, more preferably at least 95% identical, or most preferably at least 99% identical to any of the sequences shown in Table 4.

In an especially preferred embodiment the inventive mRNA additionally comprises at least one sequence section encoding a signal peptide (see therefore for example the preferred construct "secreted" shown in FIG. 1). In this context a signal peptide is preferably a peptide which leads to a co-translational transport of the encoded protein or peptide into the endoplasmatic reticulum (ER). By addition of a sequence encoding for such a signal peptide the resulting protein or peptide is effectively cotransaltionally translocated into the secretory pathway of the producing cell.

In preferred embodiments the signal peptide derives from tissue plasminogen activator (TPA) or albumin, especially human serum albumin (HSA), or CD5 (CD—cluster of differentiation) or HLA-A2 (HLA—human leucocyte antigen) or luciferase, especially Gaussian luciferase, or immunoglobulin (e.g. IgG or IgE heavy chain) or IL-2 (human IL-2) or chymotrypsinogen (human chymotrypsinogen), or a fragment, variant or derivative thereof. By inclusion of a signal peptide that is aimed to allow co-translational transport of VP8* into the ER followed by protein secretion it is possible to increase antigen accessibility to the immune system.

Preferably, the amino acid sequence of the signal peptide of tissue plasminogen activator according to SEQ ID NO: 3148 (derived from NM_000930.3; GI:132626665; 1-21aa/1-63 bp) may serve as a basis for advantageous designs of the inventive mRNA sequence.

Moreover, the amino acid sequence of the signal peptide of human serum albumin (HSA) according to SEQ ID NO: 3149 may serve as a basis for advantageous designs of the inventive mRNA sequence.

Moreover, the amino acid sequence of the signal peptide of CD5 according to SEQ ID NO: 3151 may serve as a basis for advantageous designs of the inventive mRNA sequence.

Moreover, the amino acid sequence of the signal peptide of HLA-A2 according to SEQ ID NOs: 3152-3153 may serve as a basis for advantageous designs of the inventive mRNA sequence.

Moreover, the amino acid sequence of the signal peptide of *Gaussia* luciferase according to SEQ ID NO: 3154 may serve as a basis for advantageous designs of the inventive mRNA sequence.

Moreover, the amino acid sequence of the signal peptide of immunoglobulin IgG heavy chain according to SEQ ID NO: 3155 may serve as a basis for advantageous designs of the inventive mRNA sequence.

Moreover, the amino acid sequence of the signal peptide of human IL-2 according to SEQ ID NO: 3156 may serve as a basis for advantageous designs of the inventive mRNA sequence.

Moreover, the amino acid sequence of the signal peptide of human chymotrypsinogen according to SEQ ID NO: 3157 may serve as a basis for advantageous designs of the inventive mRNA sequence.

Moreover, the amino acid sequence of the signal peptide of an immunoglobulin (human, heavy chain) according to SEQ ID NO: 3158 may serve as a basis for advantageous designs of the inventive mRNA sequence.

Moreover, the amino acid sequence of the signal peptide of an immunoglobulin (human, heavy chain) according to SEQ ID NO: 3159 may serve as a basis for advantageous designs of the inventive mRNA sequence.

Preferred amino acid sequences of the combination of a signal peptide and VP8* (full-length and shortened forms) are shown in Table 5:

TABLE 5 amino acid sequences for VP8* additionally comprising a signal peptide

| Amino acids of VP8* | SEQ ID Nos. |
|---|---|
| 2-240 | 85-104 |
| 2-230 | 181-200 |
| 11-223 | 277-296 |
| 11-240 | 373-392 |
| 21-240 | 469-488 |
| 41-223 | 565-584 |
| 65-223 | 661-680 |
| 64-223 | 753-762 |

Preferably, the inventive mRNA sequence encodes at least one amino acid sequence which is at least 60% identical, more preferably at least 70% identical, more preferably at least 80% identical, more preferably at least 90% identical, more preferably at least 95% identical, or most preferably at least 99% identical to any of the amino acid sequences as shown in Table 5 or to a respective fragment thereof.

Additionally to the amino acid sequences in Table 5 also the inventive mRNA sequences encoding the respective amino acid sequences are disclosed. In this context it is possible to apply unmodified nucleotide sequences or mRNA sequences wherein the G/C content of the coding region is increased compared to the G/C content of the coding region of its particular wild type coding sequence, i.e. the unmodified mRNA. Furthermore, mRNA sequences additionally comprising UTR sequences are disclosed in Table 6.

In especially preferred designs the inventive mRNA sequence comprises UTRs e.g. as 5'-UTR a 5'-UTR derived from 32L TOP UTR (according to SEQ ID NO. 3189), as 3'-UTR a 3'-UTR derived from human albumin 3'-UTR (according to SEQ ID NO. 3205), a histone stem-loop (according to SEQ ID NO. 3207), a poly(A) sequence, and a poly(C) sequence. Respective mRNA sequences are shown in Table 6 Column D. Alternatively the inventive mRNA sequence comprises a 3'-UTR derived from alpha globin 3'-UTR (according to SEQ ID NO. 3199), a histone stem-loop (according to SEQ ID NO. 3207), a poly(A) sequence, and a poly(C) sequence. Respective mRNA sequences are shown in Table 6 Column C.

TABLE 6 mRNA sequences encoding VP8* and additionally encoding a signal peptide

| Amino acids | SEQ ID NO(s) | | | |
|---|---|---|---|---|
| of VP8* | A | B | C | D |
| 2-240 | — | 886-905 | 1634-1653 | 2394-2413 |
| 2-230 | — | 982-1001 | 1730-1749 | 2490-2509 |
| 11-223 | — | 1078-1097 | 1826-1845 | 2586-2605 |
| 11-240 | — | 1174-1193 | 1922-1941 | 2682-2701 |
| 21-240 | — | 1270-1289 | 2018-2037 | 2778-2797 |
| 41-223 | — | 1366-1385 | 2114-2133 | 2874-2893 |

TABLE 6-continued mRNA sequences encoding VP8* and additionally encoding a signal peptide

| Amino acids of VP8* | SEQ ID NO(s) | | | |
|---|---|---|---|---|
| | A | B | C | D |
| 65-223 | — | 1462-1481 | 2210-2229 | 2970-2989 |
| 64-223 | — | 1554-1563 | 2302-2311 | 3062-3071 |

Column A = SEQ ID Nos. regarding wild type CDS (coding sequences)
Column B = SEQ ID Nos. regarding CDS (coding sequences) with an increased G/C content
Column C = SEQ ID Nos. regarding mRNA sequences comprising a CDS with an increased G/C content and comprising a 3'-UTR derived from alpha globin (according to SEQ ID No. 3199), a histon stem-loop sequence (according to SEQ ID No. 3207) and a poly(A) sequence and a poly(C) sequence.
Column D = SEQ ID Nos. regarding mRNA sequences comprising a CDS with an increased G/C content and comprising a 5'-UTR derived from 32L TOP UTR (according to SEQ ID NO. 3189), a 3'-UTR derived from albumin 3'-UTR (according to SEQ ID No. 3205), a histon stem-loop sequence (according to SEQ ID No. 3207) and a poly(A) sequence and a poly(C) sequence.

Preferably, the inventive mRNA sequence comprises or consists of a nucleotide sequence as shown in Table 6 or which is at least 60% identical, more preferably at least 70% identical, more preferably at least 80% identical, more preferably at least 85%, more preferably at least 90% identical, more preferably at least 95% identical, or most preferably at least 99% identical to any of the sequences shown in Table 6.

Preferably, the signal peptide is applied in mRNA sequences encoding at least one epitope of a rotavirus protein according to the invention in combination with a helper peptide and optionally in combination with a peptide linker (as disclosed above).

Preferred amino acid sequences of the combination of a signal peptide, a helper peptide and optionally a peptide linker together with VP8* (full-length and shortened forms) are shown in Table 7:

TABLE 7 amino acid sequences for VP8* additionally comprising a signal peptide, the P2 helper peptide and optionally a peptide linker

| Amino acids of VP8* | SEQ ID Nos. |
|---|---|
| 2-240 | 105-124 |
| 2-230 | 201-220 |
| 11-223 | 297-316 |
| 11-240 | 393-412 |
| 21-240 | 489-508 |
| 41-223 | 585-604 |
| 65-223 | 681-700 |
| 64-223 | 763-772 |

Preferably, the inventive mRNA sequence encodes at least one amino acid sequence which is at least 60% identical, more preferably at least 70% identical, more preferably at least 80% identical, more preferably at least 90% identical, more preferably at least 95% identical, or most preferably at least 99% identical to any of the amino acid sequences as shown in Table 7 or to a respective fragment thereof.

Additionally to the amino acid sequences in Table 7 also the inventive mRNA sequences encoding the respective amino acid sequences are disclosed. In this context it is possible to apply unmodified nucleotide sequences or mRNA sequences wherein the G/C content of the coding region is increased compared to the G/C content of the coding region of its particular wild type coding sequence, i.e. the unmodified mRNA. Furthermore, mRNA sequences additionally comprising UTR sequences are disclosed in Table 8.

In especially preferred designs the inventive mRNA sequence comprises UTRs e.g. as 5'-UTR a 5'-UTR derived from 32L TOP UTR (according to SEQ ID NO. 3189), as 3'-UTR a 3'-UTR derived from human albumin 3'-UTR (according to SEQ ID NO. 3205), a histone stem-loop (according to SEQ ID NO. 3207), a poly(A) sequence, and a poly(C) sequence. Respective mRNA sequences are shown in Table 8 Column D. Alternatively the inventive mRNA sequence comprises a 3'-UTR derived from alpha globin 3'-UTR (according to SEQ ID NO. 3199), a histone stem-loop (according to SEQ ID NO. 3207), a poly(A) sequence, and a poly(C) sequence. Respective mRNA sequences are shown in Table 8 Column C.

TABLE 8 mRNA sequences encoding VP8* and additionally encoding a signal peptide, the P2 helper peptide and optionally a peptide linker

| | SEQ ID NO(s) | | | |
|---|---|---|---|---|
| Amino acids | A | B | C | D |
| 2-240 | — | 906-925 | 1654-1673 | 2414-2433 |
| 2-230 | — | 1002-1021 | 1750-1769 | 2510-2529 |
| 11-223 | — | 1098-1117 | 1846-1865 | 2606-2625 |
| 11-240 | — | 1194-1213 | 1942-1961 | 2702-2721 |
| 21-240 | — | 1290-1309 | 2038-2057 | 2798-2817 |
| 41-223 | — | 1386-1405 | 2134-2153 | 2894-2913 |
| 65-223 | — | 1482-1501 | 2230-2249 | 2990-3009 |
| 64-223 | — | 1564-1573 | 2312-2321 | 3072-3081 |

Column A = SEQ ID Nos. regarding wild type CDS (coding sequences)
Column B = SEQ ID Nos. regarding CDS (coding sequences) with an increased G/C content
Column C = SEQ ID Nos. regarding mRNA sequences comprising a CDS with an increased G/C content and comprising a 3'-UTR derived from alpha globin (according to SEQ ID No. 3199), a histon stem-loop sequence (according to SEQ ID No. 3207) and a poly(A) sequence and a poly(C) sequence.
Column D = SEQ ID Nos. regarding mRNA sequences comprising a CDS with an increased G/C content and comprising a 5'-UTR derived from 32L TOP UTR (according to SEQ ID NO. 3189), a 3'-UTR derived from albumin 3'-UTR (according to SEQ ID No. 3205), a histon stem-loop sequence (according to SEQ ID No. 3207) and a poly(A) sequence and a poly(C) sequence.

Preferably, the inventive mRNA sequence comprises or consists of a nucleotide sequence as shown in Table 8 or which is at least 60% identical, more preferably at least 70% identical, more preferably at least 80% identical, more preferably at least 85%, more preferably at least 90% identical, more preferably at least 95% identical, or most preferably at least 99% identical to any of the sequences shown in Table 8.

Nevertheless, the signal peptide may also be applied in an mRNA sequence encoding the at least one epitope of a rotavirus protein according to the invention without the helper peptide.

In a particularly preferred embodiment of the inventive mRNA sequence the coding region encoding at least one epitope of a rotavirus protein, or a fragment, variant or derivative thereof, is mutated to delete at least one predicted or potential glycosylation site. As described e.g. by Chauhan et al. (PLOS ONE (2013) Vol. 8 issue 6, e67008) glycosylation is an important post-translational or co-translational modification of proteins. The majority of proteins synthesized in the rough endoplasmatic reticulum (ER) undergo glycosylation. There are mainly two types of glycosylation: a) In N-glycosylation, the addition of sugar chains takes place at the amide nitrogen on the side-chain of the asparagine or arginine. b) In O-glycosylation, the addition of sugar chains takes place on the hydroxyl oxygen on the side-chain of hydroxylysine, hydroxyproline, serine, tyrosine or threonine. Moreover, phospho-glycans linked through the phosphate of a phospho-serine and C-linked glycans, a rare form of glycosylation where a sugar is added to a carbon on a tryptophan side-chain, are known. Since VP8* or some other rotavirus proteins are not glycosylated in the viral life cycle (Prasad B.V.V. et al., 1988,199(2):269-275), entry in the ER might lead to modifications by glycosylation that could lead to epitope shielding and therefore prevent an efficient immune response. Therefore, it is particularly advantageous to delete the potential glycosylation sites of the encoded rotavirus protein. By mutation of the relevant amino acids the glycosylation is prevented. In this context preferably at least one codon coding for an asparagine, arginine, serine, threonine, tyrosine, lysine, proline or tryptophan is mutated in such a way that a different amino acid is encoded thereby deleting at least one predicted or potential glycosylation site. The predicted glycosylation sites may be predicted by using artificial neural networks that examine the sequence for common glycosylation sites, e.g. N-glycosylation sites may be predicted by using the NetNGlyc 1.0 Server.

In an especially preferred embodiment of the inventive mRNA sequence encoding at least one epitope of a rotavirus protein at least one codon coding for asparagine (N) is mutated into a codon coding for glutamine (Q). Thereby, the sequence is modified to encode for Q instead of N at predicted N-glycosylation sites, for example at predicted N-glycosylation sites of the encoded VP8* protein, or a fragment, variant or derivative thereof. In this context the term "mutated VP8*" means that at least one (predicted) glycosylation site is mutated.

It is preferred that not all predicted glycosylation sites of the coding region encoding at least one epitope of a rotavirus protein, or a fragment, variant or derivative thereof, are mutated to partially prevent glycosylation of the resulting protein or peptide. This aspect of the invention may apply for e.g. all N-glycosylation sites or for all O-glycosylation sites or for all glycosylation sites irrespective of their biochemical nature.

It is particularly preferred that all predicted glycosylation sites of the coding region encoding at least one epitope of a rotavirus protein, or a fragment, variant or derivative thereof, are mutated to completely prevent glycosylation of the resulting protein or peptide. This aspect of the invention may apply for e.g. all N-glycosylation sites or for all O-glycosylation sites or for all glycosylation sites irrespective of their biochemical nature.

A preferred amino acid sequence for mutated VP8* of P-serotype P[4] is shown in SEQ ID NO. 125, wherein N-glycosylation modifications were done at N67Q; N91Q; N132Q; N148Q; N230Q.

A preferred amino acid sequence for mutated VP8* of P-serotype P[6] is shown in SEQ ID No. 126, wherein N-glycosylation modifications were done at N67Q; N91Q; N132Q; N146Q.

A preferred amino acid sequence for mutated VP8* of P-serotype P[6] is shown in SEQ ID No. 3210, wherein N-glycosylation modifications were done at N67Q; N91Q; N132Q; N146Q and.

A preferred amino acid sequence for mutated VP8* of P-serotype P[8] is shown in SEQ ID NO. 127 and SEQ ID NO. 128, wherein N-glycosylation modifications were done at N67Q; N91Q; N132Q.

Preferred amino acid sequences of mutated VP8* (full-length and shortened forms optional in combination with helper peptide (and peptide linker) and/or signal peptide) comprising N-glycosylation modifications are shown in Table 9:

TABLE 9 amino acid sequences for mutated VP8* (full-length and shortened forms)

| Amino acids of VP8* | Protein sequence of mutated VP8* SEQ ID Nos. | Additional helper peptide P2 and additional signal peptide SEQ ID Nos. | Additional helper peptide P2 and peptide linker SEQ ID Nos. | Additional signal peptide SEQ ID Nos. | Additional helper peptide P2, peptide linker and signal peptide SEQ ID Nos. |
|---|---|---|---|---|---|
| 2-240 | 125-128; 3210 | 804-806 | 129-132; 3211 | 133-152; 3212-3216 | 153-172; 3217-3221 |
| 2-230 | 221-224; 3222 | | 225-228; 3223 | 229-248; 3224-3228 | 249-268; 3229-3233 |
| 11-223 | 317-320; 3234 | | 321-324; 3235 | 325-344; 3236-3240 | 345-364; 3241-3245 |
| 11-240 | 413-416; 3246 | | 417-420; 3247 | 421-440; 3248-3252 | 441-460; 3253-3257 |
| 21-240 | 509-512; 3258 | | 513-516; 3259 | 517-536; 3260-3264 | 537-556; 3265-3269 |
| 41-223 | 605-608; 3270 | | 609-612; 3271 | 613-632; 3272-3276 | 633-652; 3277-3281 |
| 65-223 | 701-704; 3282 | 809-810 | 705-708; 3283 | 709-728; 3284-3288 | 729-748; 3289-3293 |
| 64-223 | 773-774; 3294 | 807-808 | 775-776; 3295 | 777-786; 3296-3300 | 787-796; 3301-3305 |

Preferably, the inventive mRNA sequence encodes at least one amino acid sequence which is at least 60% identical, more preferably at least 70% identical, more preferably at least 80% identical, more preferably at least 90% identical, more preferably at least 95% identical, or most preferably at least 99% identical to any of the amino acid sequences as shown in Table 9 or to a respective fragment thereof.

Additionally to the amino acid sequences in Table 9 also the inventive mRNA sequences encoding the respective amino acid sequences are disclosed. In this context it is possible to apply unmodified nucleotide sequences or mRNA sequences wherein the G/C content of the coding region is increased compared to the G/C content of the coding region of its particular wild type coding sequence, i.e. the unmodified mRNA. Furthermore, mRNA sequences additionally comprising UTR sequences are disclosed in Tables 10-13.

In especially preferred designs the inventive mRNA sequence comprises UTRs e.g. as 5'-UTR a 5'-UTR derived from 32L TOP UTR (according to SEQ ID NO. 3189), as 3'-UTR a 3'-UTR derived from human albumin 3'-UTR (according to SEQ ID NO. 3205), a histone stem-loop (according to SEQ ID NO. 3207), a poly(A) sequence, and a poly(C) sequence. Respective mRNA sequences are shown in Tables 10-13 Column D. Alternatively the inventive mRNA sequence comprises a 3'-UTR derived from alpha globin 3'-UTR (according to SEQ ID NO. 3199), a histone stem-loop (according to SEQ ID NO. 3207), a poly(A) sequence, and a poly(C) sequence. Respective mRNA sequences are shown in Tables 10-13 Column C.

TABLE 10 mRNA sequences encoding mutated VP8* (full-length and shortened forms)

| Amino acids of VP8* | SEQ

TABLE 13-continued mRNA sequences encoding mutated VP8* (full-length and shortened forms),
the P2 helper peptide, optionally a peptide linker and a signal peptide

| Amino acids | SEQ ID NO(s) | | | |
|---|---|---|---|---|
| of VP8* | A | B | C | D |
| 64-223 | 848-849 | 1588-1597; 1608-1609; 3397-3401 | 2336-2345; 2356-2357; 3493-3497 | 3096-3105; 3116-3117; 3589-3593 |

Column A = SEQ ID Nos. regarding wild type CDS (coding sequences)
Column B = SEQ ID Nos. regarding CDS (coding sequences) with an increased G/C content
Column C = SEQ ID Nos. regarding mRNA sequences comprising a CDS with an increased G/C content and comprising a 3'-UTR derived from alpha globin (according to SEQ ID No. 3199), a histon stem-loop sequence (according to SEQ ID No. 3207) and a poly(A) sequence and a poly(C) sequence.
Column D = SEQ ID Nos. regarding mRNA sequences comprising a CDS with an increased G/C content and comprising a 5'-UTR derived from 32L TOP UTR (according to SEQ ID NO. 3189), a 3'-UTR derived from albumin 3'-UTR (according to SEQ ID No. 3205), a histon stem-loop sequence (according to SEQ ID No. 3207) and a poly(A) sequence and a poly(C) sequence.

Preferably, the inventive mRNA sequence comprises or consists of a nucleotide sequence as shown in Tables 10-13 or which is at least 60% identical, more preferably at least 70% identical, more preferably at least 80% identical, more preferably at least 85%, more preferably at least 90% identical, more preferably at least 95% identical, or most preferably at least 99% identical to any of the sequences shown in Tables 10-13.

In a particularly preferred embodiment of the inventive mRNA sequence the sequence additionally comprises at least one sequence section encoding a transmembrane domain of a protein, or a fragment, variant or derivative thereof. The addition of a sequence encoding a transmembrane domain of a protein of a fragment, variant of derivative thereof may enhance the expression of the antigen on the surface of the expressing cell. By addition of a transmembrane domain to the translated product according to this aspect of the invention it is possible to further enhance the immune response, wherein the translated rotavirus protein, e.g. VP8*, anchors to the plasma membrane thereby increasing immune responses by antigen clustering.

According to a preferred embodiment of the invention the transmembrane domain is selected from the transmembrane domain of hemagglutinin (HA) of Influenza virus, or Env of HIV-1 (Human Immunodeficiency Virus), or EIAV (equine infectious anemia virus), or MLV (murine leukemia virus), or mouse mammary tumor virus, or G protein of VSV (vesicular stomatitis virus), or Rabies virus, or a fragment, variant or derivative of these proteins. Preferably, the at least one sequence section encoding the transmembrane domain is located 3' of the coding region, encoding at least one epitope of a rotavirus protein or fragment, variant or derivative thereof. That means that in the translated product the transmembrane domain is fused to the C-term of the rotavirus protein (see therefore for example the preferred construct "Transmembrane" shown in FIG. 1).

The transmembrane domain of hemagglutinin of influenza virus is especially preferred. Preferably, the amino acid sequence of the transmembrane domain of Influenza hemagglutinin (HA) according to SEQ ID NO: 3160 (derived from CY148227.1; GI:538117274; HA/Netherlands/602/2009) may serve as a basis for advantageous designs of the inventive mRNA sequence.

Moreover, the amino acid sequence of the transmembrane domains of Env of HIV-1 according to SEQ ID NOs: 3161-3163 (derived from BAF32550.1; GI:114842138) may serve as a basis for advantageous designs of the inventive mRNA sequence. In addition, the amino acid sequence of the transmembrane domains of Env of EIAV according to SEQ ID NOs: 3164-3166 (derived from AAC03762.1; GI:2905989) or the amino acid sequence of the transmembrane domain of Env of MLV according to the SEQ ID NO:3167 (derived from AAA46526.1; GI:332067) may serve as a basis for advantageous designs of the inventive mRNA sequence.

Further preferred amino acid sequences are the transmembrane domains of Env of mouse mammery tumor virus according to SEQ ID NOs: 3168-3169 (derived from BAA03768.1; GI:391744).

Moreover, the amino acid sequence of the transmembrane domains of the G protein of VSV according to SEQ ID NO: 3170 (derived from CAA24525.1; GI:61840) or of the G protein of Rabies according to SEQ ID NO: 3171 (derived from AEV43288.1; GI:359374323) may serve as a basis for advantageous designs of the inventive mRNA sequence.

In an especially preferred embodiment of the inventive mRNA sequence a sequence section encoding the transmembrane brane domain (preferably the transmembrane of Influenza HA according to SEQ ID NO. 3160) is fused to the 3'-end of the VP8* coding region, wherein preferably also sequence sections encoding a signal peptide, preferably tissue plasminogen activator according to SEQ ID NO. 3148, and/or a helper peptide, preferably P2 helper peptide of tetanus toxin according to SEQ ID NO. 3147, and optionally a peptide linker are added to the 5'-end of the VP8* coding region. Preferably also feature mutations of the N-glycosylation sites are added, as described above. Preferred constructs refer to VP8* and to the shortened forms of VP8*, preferably of the serotypes P[4], P[6] and P[8].

Preferred amino acid sequences are shown in Table 14:

TABLE 14 amino acid sequences for mutated VP8* (full-length and shortened forms)
additionally comprising a transmembrane domain, and a signal peptide,
the P2 helper peptide and optionally a peptide linker

| Amino acids of VP8* | SEQ ID Nos. |
|---|---|
| 2-240 | 811-813 |
| 65-223 | 816-817 |
| 64-223 | 814-815 |

Preferably, the inventive mRNA sequence comprises a coding region which encodes for the amino acid sequences according to any one of Table 14 or amino acid sequences which show an identity of at least 60%, preferably at least 70%, more preferably at least 80%, more preferably at least 90%, more preferably at least 95%, or most preferably at least 99% to the sequences as shown in Table 14.

Additionally to the amino acid sequences in Table 14 also the inventive mRNA sequences encoding the respective amino acid sequences are disclosed. In this context it is possible to apply unmodified nucleotide sequences or mRNA sequences wherein the G/C content of the coding region is increased compared to the G/C content of the coding region of its particular wild type coding sequence, i.e. the unmodified mRNA. Furthermore, mRNA sequences additionally comprising UTR sequences are disclosed in Table 15.

In especially preferred designs the inventive mRNA sequence comprises UTRs e.g. as 5'-UTR a 5'-UTR derived from 32L TOP UTR (according to SEQ ID NO. 3189), as 3'-UTR a 3'-UTR derived from human albumin 3'-UTR (according to SEQ ID NO. 3205), a histone stem-loop (according to SEQ ID NO. 3207), a poly(A) sequence, and a poly(C) sequence. Respective mRNA sequences are shown in Table 15 Column D. Alternatively the inventive mRNA sequence comprises a 3'-UTR derived from alpha globin 3'-UTR (according to SEQ ID NO. 3199), a histone stem-loop (according to SEQ ID NO. 3207), a poly(A) sequence, and a poly(C) sequence. Respective mRNA sequences are shown in Table 15 Column C.

TABLE 15 mRNA sequences encoding mutated VP8* (full-length and shortened forms) additionally encoding a transmembrane domain, and a signal peptide, the P2 helper peptide and optionally a peptide linker

| Amino acids | SEQ ID NO(s) | | | |
|---|---|---|---|---|
| | A | B | C | D |
| 2-240 | | 852-854; 1612-1614 | 2360-2362 | 3120-3122 |
| 65-223 | | 857-858; 1617-1618 | 2365-2366 | 3125-3126 |
| 64-223 | | 855-856; 1615-1616 | 2363-2364 | 3123-3124 |

Column A = SEQ ID Nos. regarding wild type CDS (coding sequences)
Column B = SEQ ID Nos. regarding CDS (coding sequences) with an increased G/C content
Column C = SEQ ID Nos. regarding mRNA sequences comprising a CDS with an increased G/C content and comprising a 3'-UTR derived from alpha globin (according to SEQ ID No. 3199), a histon stem-loop sequence (according to SEQ ID No. 3207) and a poly(A) sequence and a poly(C) sequence.
Column D = SEQ ID Nos. regarding mRNA sequences comprising a CDS with an increased G/C content and comprising a 5'-UTR derived from 32L TOP UTR (according to SEQ ID NO. 3189), a 3'-UTR derived from albumin 3'-UTR (according to SEQ ID No. 3205), a histon stem-loop sequence (according to SEQ ID No. 3207) and a poly(A) sequence and a poly(C) sequence.

Preferably, the inventive mRNA sequence comprises or consists of a nucleotide sequence as shown in Table 15 or which is at least 60% identical, more preferably at least 70% identical, more preferably at least 80% identical, more preferably at least 85%, more preferably at least 90% identical, more preferably at least 95% identical, or most preferably at least 99% identical to any of the sequences shown in Table 15.

In a particularly preferred embodiment of the inventive mRNA sequence the sequence additionally comprises at least one sequence section encoding a peptide or protein enabling VLP (virus like particle) formation. By formation of virus like particles it is possible to further increase immune responses by antigen clustering. Generally, virus like particles resemble viruses, but they are non-infectious because they do not contain any viral genetic material. The expression of viral structural proteins or peptides in the context of the inventive mRNA results in the self-assembly of virus like particles which enhance the immungenicity of the inventive approach. In general, VLP formation can be facilitated via two distinct mechanisms for the purpose of the invention:

a) The VLP forming protein or peptide is co-expressed with the rotavirus antigen, resulting in separate translation products (rotavirus protein construct and VLP forming protein or peptide). This co-expression may be achieved by using one single multicistronic mRNA construct or at least two separate mRNA constructs. The co-expression of the VLP forming proteins or peptides preferably results in the formation of VLPs with a lipid envelope. Preferably, viral VLP forming proteins or peptides such as the Gag protein of HIV-1, EIAV or MLV, or matrix proteins of vesicular stomatitis virus (VSV) or Rabies or VP40 of Ebola virus may be used. The design for co-expression may comprise a first mRNA construct encoding at least one epitope of a rotavirus protein, e.g. VP8*, in membrane bound form generated by fusion with a transmembrane domain, e.g. derived from the HA protein of Influenza virus, and an N-terminal signal peptide, and at least a second mRNA construct providing the VLP forming peptide or protein.

b) The VPL enabling peptide or protein is fused (directly or indirectly) to the coding region encoding the at least one epitope of the rotavirus protein (or fragment, variant or derivative thereof), that means the sequence section encoding the VLP enabling peptide or protein is integrated into the mRNA construct thereby resulting in a fusion protein. The fusion of the VLP enabling peptide or protein with the rotavirus protein generally results in VLPs without envelope.

Advantageously, the peptide or protein enabling VLP formation is derived from non-human pathogenic viruses, because potential problems with pre-existing immunity by using proteins derived from the human viruses are avoided. Non-human pathogenic viruses refer to viruses that normally do not infect humans.

In especially preferred embodiments the peptide or protein enabling VLP formation is derived from Hepatitis B virus core antigen (HBcAg) or from Alfalfa mosaic virus coat protein (CP).

Hepatitis B virus core antigen (HBcAg), which is able to assemble into VLPs, is a well-documented carrier of foreign antigens (reviewed in Buonaguro L, Expert Rev Vaccines. 2011; 10(11):1569-1583). Mostly preferred is Woodchuck Hepatitis virus core protein (WHcAg), as the basis for VLP formation. The use of Woodchuck Hepatitis virus core protein has the particular advantage, that potential problems with pre-existing immunity by using proteins derived from the human Hepatitis B (Billaud J N, J Virol. 2005 November; 79(21):13641-13655) are avoided.

Preferably, the peptide or protein enabling VLP formation comprises or consists of the amino acid sequence of Woodchuck Hepatitis virus core protein (WHcAg) according to SEQ ID NO: 3172 (derived from NCBI accession no.: NC_004107.1; 1-149 with C-terminal C added; derived from publication: PMID 16227284) may serve as a basis for advantageous designs of the inventive mRNA sequence.

In a further preferred embodiment the peptide or protein enabling VLP formation comprises or consists of the amino acid sequence of Alfalfa mosaic virus CP (AIMV CP) according to SEQ ID NO: 3173 (derived from NCBI accession no.: NP_041195.1; derived from publication: PMID 24260245) may serve as a basis for advantageous designs of the inventive mRNA sequence.

Preferably, the sequence section encoding the peptide or protein enabling VLP formation derived from WHcAg is located 5' of the coding region encoding the at least one epitope of the rotavirus protein resulting in an N-terminal fusion to the rotavirus protein. If the construct additionally comprises a sequence section(s) encoding a helper peptide, the sequence section encoding the peptide or protein enabling VLP formation is preferably located 5' of the helper peptide. If the construct additionally comprises sequence sections encoding a signal peptide, the sequence section encoding the peptide or protein enabling VLP formation is preferably located 3' of the signal peptide.

The sequence section encoding the peptide or protein enabling VLP formation derived from Alfalfa mosaic virus CP is preferably located 3' of the coding region for the rotavirus protein resulting in C-terminal fusion of CP to the rotavirus protein, wherein preferably the construct additionally comprises sequence sections encoding a helper peptide and/or a signal peptide at the 5' end of the coding region for the rotavirus protein.

In particular preferred embodiments in the context of fusion proteins according to the invention the sequence section encoding the peptide or protein enabling VLP formation is separated from the coding region for the rotavirus protein by at least one sequence section encoding a peptide linker. If the sequence section encoding the rotavirus protein is combined with a sequence section encoding a helper peptide at the 5'-end of the sequence section encoding the peptide linker may separate the VLP forming peptide or protein from the helper peptide plus rotavirus protein.

Preferably, the sequence section encoding the peptide linker is coding for a flexible or a rigid linker as disclosed above.

In preferred embodiments the inventive mRNA sequence comprises at least one sequence section encoding a peptide linker according to SEQ ID Nos. 3174-3176 Furthermore, the mRNA sequence according to this aspect of the invention preferably comprises a sequence section coding for an N-terminal signal peptide, as described above. Preferably, the predicted N-glycosylation sites are mutated, as described above.

In an especially preferred embodiment a relevant portion of WHcAg is fused to the N-term of VP8*, separated by a short peptide linker as described above. Furthermore, the construct preferably contains an N-terminal signal peptide. The predicted N-glycosylation sites are removed from VP8* (see therefore the preferred construct "VLP" in FIG. 1).

Preferred amino acid sequences are shown in Table 16:

TABLE 16 amino acid sequences for mutated VP8* (full-length and shortened forms) additionally comprising a signal peptide, the VLP enabling protein WHcAg, a peptide linker, and the P2 helper peptide

| Amino acids of VP8* | SEQ ID Nos. |
| --- | --- |
| 2-240 | 818-820 |
| 65-223 | 823-824 |
| 64-223 | 821-822 |

Preferably, the inventive mRNA sequence comprises a coding region which encodes for the amino acid sequences according to any one of Table 16 or amino acid sequences which show an identity of at least 60%, preferably at least 70%, more preferably at least 80%, more preferably at least 90%, more preferably at least 95%, or most preferably at least 99% to the sequences as shown in Table 16. Additionally to the amino acid sequences in Table 16 also the inventive mRNA sequences encoding the respective amino acid sequences are disclosed. In this context it is possible to apply unmodified nucleotide sequences or mRNA sequences wherein the G/C content of the coding region is increased compared to the G/C content of the coding region of its particular wild type coding sequence, i.e. the unmodified mRNA. Furthermore, mRNA sequences additionally comprising UTR sequences are disclosed in Table 17.

In especially preferred designs the inventive mRNA sequence comprises UTRs e.g. as 5'-UTR a 5'-UTR derived from 32L TOP UTR (according to SEQ ID NO. 3189), as 3'-UTR a 3'-UTR derived from human albumin 3'-UTR (according to SEQ ID NO. 3205), a histone stem-loop (according to SEQ ID NO. 3207), a poly(A) sequence, and a poly(C) sequence. Respective mRNA sequences are shown in Table 17 Column D. Alternatively the inventive mRNA sequence comprises a 3'-UTR derived from alpha globin 3'-UTR (according to SEQ ID NO. 3199), a histone stem-loop (according to SEQ ID NO. 3207), a poly(A) sequence, and a poly(C) sequence. Respective mRNA sequences are shown in Table 17 Column C.

TABLE 17 mRNA sequences encoding mutated VP8* (full-length and shortened forms) additionally encoding a signal peptide, the VLP enabling protein WHcAg, a peptide linker, and the P2 helper peptide

| Amino acids | SEQ ID NO(s) | | | |
| --- | --- | --- | --- | --- |
| | A | B | C | D |
| 2-240 | 859-861 | 1619-1621 | 2367-2369 | 3127-3129 |
| 65-223 | 864-865 | 1624-1625 | 2372-2373 | 3132-3133 |
| 64-223 | 862-863 | 1622-1623 | 2370-2371 | 3130-3131 |

Column A = SEQ ID Nos. regarding wild type CDS (coding sequences)
Column B = SEQ ID Nos. regarding CDS (coding sequences) with an increased G/C content
Column C = SEQ ID Nos. regarding mRNA sequences comprising a CDS with an increased G/C content and comprising a 3'-UTR derived from alpha globin (according to SEQ ID No. 3199), a histon stem-loop sequence (according to SEQ ID No. 3207) and a poly(A) sequence and a poly(C) sequence.
Column D = SEQ ID Nos. regarding mRNA sequences comprising a CDS with an increased G/C content and comprising a 5'-UTR derived from 32L TOP UTR (according to SEQ ID NO. 3189), a 3'-UTR derived from albumin 3'-UTR (according to SEQ ID No. 3205), a histon stem-loop sequence (according to SEQ ID No. 3207) and a poly(A) sequence and a poly(C) sequence.

Preferably, the inventive mRNA sequence comprises or consists of a nucleotide sequence as shown in Table 17 or which is at least 60% identical, more preferably at least 70% identical, more preferably at least 80% identical, more preferably at least 85%, more preferably at least 90% identical, more preferably at least 95% identical, or most preferably at least 99% identical to any of the sequences shown in Table 17.

In an especially preferred embodiment a relevant portion of the amino acid sequence of Alfalfa mosaic virus CP is fused to the N-term of VP8*, separated by a short peptide linker as described above. Furthermore, the construct preferably contains an N-terminal signal peptide. The predicted N-glycosylation sites may be removed from VP8*. The region of Alfalfa mosaic virus CP may replace the relevant portion of WHcAg in all disclosed sequences or constructs.

Preferably, the inventive mRNA sequence comprises at least two coding regions, each encoding at least one epitope of a rotavirus protein respectively of a protein of a virus of the genus rotavirus, or of a fragment, variant or derivative thereof. Preferably, the mRNA sequence comprises at least three or four coding regions.

In preferred embodiments of this aspect of the invention the rotavirus proteins derive from different serotypes of the rotavirus, wherein preferably the at least one epitope is derived from the same protein. In particular preferred embodiment the at least one epitope is derived from VP8*. It is possible that the inventive mRNA construct comprises two or more coding regions each encoding the same or different epitopes of the same rotavirus protein, e.g. VP8*, of different serotypes, wherein two or more coding regions encoding the same epitope of the same rotavirus protein, e.g. VP8*, of different serotypes is preferred.

In further preferred embodiments of this aspect of the invention the two or more coding regions encodes epitopes of rotavirus proteins derived from the same serotype of rotavirus. It is possible that the mRNA sequence encodes different epitopes of the same rotavirus protein, preferably VP8*, or that the mRNA sequence encodes two or more copies (or repeats) of the same coding region encoding the same epitope or the same rotavirus protein, preferably VP8*, of the same serotype. It is also possible that the mRNA construct encodes epitopes of two or more different rotavirus proteins of the same or different serotypes.

To further illustrate this aspect of the invention the following examples of preferred inventive mRNA sequences comprise two or more repeats, for example four repeats (i.e. in summary four times the same sequence), of the same coding region encoding at least one epitope of a VP8* protein, or a fragment, variant or derivative thereof, of a virus of the genus rotavirus. The VP8* coding regions of the repeats are preferably combined with sequence sections encoding a helper peptide, especially P2 helper peptide of tetanus toxin, and/or a signal peptide for co-translational transport into the ER, especially tissue plasminogen activator, and/or a transmembrane domain, and/or a peptide or protein enabling VLP formation, especially derived from WHcAg, and/or a peptide linker, as disclosed above or fragments, variants or derivatives thereof.

In preferred embodiments the inventive mRNA sequence comprises at least one sequence section encoding a peptide linker according to SEQ ID NOs: 3174-3176

Preferably, the predicted N-glycosylation sites are mutated, as described above.

VP8* is a relatively small antigen. By the use of repeats of the coding region within the inventive mRNA sequence it is possible to increase antigen clustering, thereby increasing immune responses. Generally, the number of repeats is only limited by practical consideration. For example, four repeats of the VP8* coding region is suitable for the inventive mRNA sequence. In a particularly preferred embodiment of the invention the secreted form described above was used as a basis for this, so the repeat design also contains one N-terminal signal peptide (tissue plasminogen activator) followed by four repeats of VP8*, in which the predicted N-glycosylation sites were mutated (see therefore the preferred construct "secreted-repeat" in FIG. 1). Preferred constructs refer to the serotypes P[4], P[6] and P[8].

In a preferred embodiment, the repeats of the coding region may be separated by a peptide linker as described above. The inventive mRNA sequence therefore may comprise at least one sequence section encoding a peptide linker according to SEQ ID NOs: 3174-3176

Preferred amino acid sequences are shown in Table 18.

TABLE 18 amino acid sequences comprising a signal peptide, 4 repeats of mutated (mutated glycosylation sites) VP8* and the P2 helper peptide

| Amino acids of VP8* | SEQ ID Nos. |
|---|---|
| 2-240 | 825-827 |

Preferably, the inventive mRNA sequence comprises a coding region which encodes for the amino acid sequences according to any one of Table 18 or amino acid sequences which show an identity of at least 60%, preferably at least 70%, more preferably at least 80%, more preferably at least 90%, more preferably at least 95%, or most preferably at least 99% to the sequences as shown in Table 18.

Additionally to the amino acid sequences in Table 18 also the inventive mRNA sequences encoding the respective amino acid sequences are disclosed. In this context it is possible to apply unmodified nucleotide sequences or mRNA sequences wherein the G/C content of the coding region is increased compared to the G/C content of the coding region of its particular wild type coding sequence, i.e. the unmodified mRNA. Furthermore, mRNA sequences additionally comprising UTR sequences are disclosed in Table 19.

In especially preferred designs the inventive mRNA sequence comprises UTRs e.g. as 5'-UTR a 5'-UTR derived from 32L TOP UTR (according to SEQ ID NO. 3189), as 3'-UTR a 3'-UTR derived from human albumin 3'-UTR (according to SEQ ID NO. 3205), a histone stem-loop (according to SEQ ID NO. 3207), a poly(A) sequence, and a poly(C) sequence. Respective mRNA sequences are shown in Table 19 Column D. Alternatively the inventive mRNA sequence comprises a 3'-UTR derived from alpha globin 3'-UTR (according to SEQ ID NO. 3199), a histone stem-loop (according to SEQ ID NO. 3207), a poly(A) sequence, and a poly(C) sequence. Respective mRNA sequences are shown in Table 19 Column C.

TABLE 19 mRNA sequences encoding a signal peptide, 4 repeats of mutated (mutated glycosylation sites) VP8* and the P2 helper peptide

| Amino acids | SEQ ID NO(s) | | | |
|---|---|---|---|---|
| | A | B | C | D |
| 2-240 | 866-868 | | 2374-2376 | 3134-3136 |

Column A = SEQ ID Nos. regarding wild type CDS (coding sequences)
Column B = SEQ ID Nos. regarding CDS (coding sequences) with an increased G/C content
Column C = SEQ ID Nos. regarding mRNA sequences comprising a CDS with an increased G/C content and comprising a 3'-UTR derived from alpha globin (according to SEQ ID No. 3199), a histon stem-loop sequence (according to SEQ ID No. 3207) and a poly(A) sequence and a poly(C) sequence.
Column D = SEQ ID Nos. regarding mRNA sequences comprising a CDS with an increased G/C content and comprising a 5'-UTR derived from 32L TOP UTR (according to SEQ ID NO. 3189), a 3'-UTR derived from albumin 3'-UTR (according to SEQ ID No. 3205), a histon stem-loop sequence (according to SEQ ID No. 3207) and a poly(A) sequence and a poly(C) sequence.

Preferably, the inventive mRNA sequence comprises or consists of a nucleotide sequence as shown in Table 19 or which is at least 60% identical, more preferably at least 70% identical, more preferably at least 80% identical, more preferably at least 85%, more preferably at least 90% identical, more preferably at least 95% identical, or most preferably at least 99% identical to any of the sequences shown in Table 19.

The inventive mRNA sequence comprising two or more coding regions each encoding at least one epitope of a rotavirus protein as mentioned in the previous paragraphs may also be designed as an mRNA sequence with a multicistronic coding region, wherein the term "multicistronic" in this context is meant to describe an mRNA sequence that codes for two or more (same or different) translation products. By the use of an mRNA sequence with a multicistronic coding region it is possible to induce immune responses against different rotavirus serotypes and/or against different rotavirus antigens/proteins. Generally, it is known that in the context of rotavirus infections there is no cross-protection against infection between the different serotypes. The inventive mRNA sequence according to this aspect of the invention is multivalent to confer full protection against different rotavirus infections.

Each coding region may comprise independently from each other a helper peptide and/or a signal peptide and/or a transmembrane domain, and/or a peptide or protein enabling VLP formation, and/or a peptide linker. In each coding region at least one or all predicted glycosylation sites may be removed.

Preferably, the inventive mRNA sequence according to this aspect of the invention combines the coding sequence of two or more VP8* proteins derived from different serotypes, e.g. serotype P[4], P[6] and P[8]. Nevertheless, it is also possible to combine the coding regions of VP8* (or other rotavirus proteins) of one or more serotypes with the coding regions of one or more different antigens of rotavirus, wherein also antigens of different serotypes may be applied.

For the design of a multicistronic mRNA construct according to the invention the at least two coding regions (coding sections), each encoding at least one epitope of a rotavirus protein, are separated by intermitting sequences, for example by internal ribosomal entry sites (IRES). Preferred examples are IRES of encephalomyocarditis virus (EMCV) and/or IRES of foot-and-mouth disease virus (FMDV). By separating the coding sections by intermitting sequences it is ensured, that each coding section is translated into a separate peptide or protein which is able to induce an immune response. Another possibility to separate the coding sections of the multicistronic coding region is the use of further intermitting sequence sections encoding for a self-cleaving peptide. Preferred examples of self-cleaving peptides are F2A peptide derived from foot-and-mouth diseases virus or self-cleaving peptides from equine rhinitis A virus or Thosea asigna virus or porcine teschovirus-1.

A preferred example of an intermitting sequence is the nucleotide sequence of EMCV-IRES-4 according to SEQ ID NO: 3181 that may serve as a basis for advantageous designs of the inventive mRNA sequence.

Another preferred example is the nucleotide sequence of FMDV IRES strain C, isolate c-s8c1 (drived from GenBank: AJ133357.1; GI:6318187; 5' UTR 578-1038; start codon defined from PMID: 8389904) according to SEQ ID NO: 3182 may serve as a basis for advantageous designs of the inventive mRNA sequence, wherein the alternative start codon on position 454-456 was removed by nucleotide changing T454A. Moreover, a point mutation according to PMID: 8389904: T86C was introduced. Moreover, the following sequences encoding self-cleaving peptides may be used, wherein SEQ ID NOs: 3177 and 3179 refer to F2Amod1 and SEQ ID NOs: 3178 and 3180 refer to F2Amod2.

Preferably, the inventive mRNA sequence comprises sequences according to any one of the SEQ ID NOs: 3179-3180.

It is further contemplated that different types of intermitting sequences (e.g. IRES sequences and sequences coding for self-cleaving peptides) can be used in combination in one multicistronic mRNA construct. For example, in a multicistronic construct comprising three coding regions, the intermitting sequence between the first and second coding region may be an IRES and the intermitting sequence between the second and third coding region may encode a self-cleaving peptide.

In particularly preferred embodiments of this aspect of the invention, the basic (P2 VP8*), secreted (P2 VP8* plus signal peptide) and membrane-bound (P2 VP8* plus transmembrane domain of Influenza HA plus signal peptide) forms or constructs of P2 VP8* of the serotypes P[8] and P[6] and P[4] as described above or as illustrated in FIG. 1 are encoded in multicistronic constructs either separated via an IRES derived from EMCV or an IRES derived from FMDV. Since the function of IRES is mediated on the basis of their nucleotide sequence, the IRES sequences in the final constructs are not sequence-optimized. Alternatively, the self-cleaving peptide F2A peptide derived from FMDV is employed in further preferred embodiments.

In a particularly preferred embodiment a multicistronic mRNA sequence encodes VP8* of serotype P[8] and serotype P[6] and serotype P[4].

Particularly preferred mRNA sequences are shown in Table 20.

TABLE 20 mRNA sequences encoding multicistronically P2 helper peptide together with VP8* (wild type or mutated; full-length and shortened forms) of serotype P[8] and serotype P[6] and serotype P[4] separated by an IRES sequence or by a sequence encoding a self-cleaving peptide and optionally encoding a transmembrane domain

| Amino acids of VP8* | SEQ ID NO(s) | | | |
|---|---|---|---|---|
| | A | B | C | D |
| 2-240 wild type | 869-871 | | 2377-2379 | 3137-3139 |
| 2-240 glycosylation sites mutated | 872-874 | | 2380-2382 | 3140-3142 |
| 2-240 glycosylation sites mutated and encoding a transmembrane domain | 875-877 | | 2383-2385 | 3143-3145 |

Column A = SEQ ID Nos. regarding wild type CDS (coding sequences
Column B = SEQ ID Nos. regarding CDS (coding sequences) with an increased G/C content
Column C = SEQ ID Nos. regarding mRNA sequences comprising a CDS with an increased G/C content and comprising a 3'-UTR derived from alpha globin (according to SEQ ID No. 3199), a histon stem-loop sequence (according to SEQ ID No. 3207) and a poly(A) sequence and a poly(C) sequence.
Column D = SEQ ID Nos. regarding mRNA sequences comprising a CDS with an increased G/C content and comprising a 5'-UTR derived from 32L TOP UTR (according to SEQ ID NO. 3189), a 3'-UTR derived from albumin 3'-UTR (according to SEQ ID No. 3205), a histon stem-loop sequence (according to SEQ ID No. 3207) and a poly(A) sequence and a poly(C) sequence.

Preferably, the inventive mRNA sequence comprises or consists of a nucleotide sequence which is at least 60% identical, more preferably at least 70% identical, more preferably at least 80% identical, more preferably at least 90% identical, more preferably at least 95% identical, or most preferably at least 99% identical to any of the sequences as shown in Table 20.

According to an especially preferred embodiment of the invention, the at least one coding region of the mRNA sequence is modified. Preferably the mRNA is stabilized by modifying and increasing the G (guanosine)/C (cytosine) content of the coding region of the mRNA thereof. Therein, the G/C content of the coding region of the mRNA is increased compared to the G/C content of the coding region of its particular wild type coding sequence, i.e. the unmodified mRNA. However, the encoded amino acid sequence of the mRNA is preferably not modified compared to the encoded amino acid sequence of the particular wild type/unmodified mRNA. The term wild type is to be understood according to the skilled person's general understanding in the art and denotes the nucleic acid or the mRNA in the form of its occurrence in nature without any mutation or nucleotide amendment by man.

The modification of the G/C content of the inventive mRNA sequence is based on the fact that RNA sequences having an increased G (guanosine)/C (cytosine) content are more stable than RNA sequences having an increased A (adenosine)/U (uracil) content. The codons of a coding sequence or a whole RNA might therefore be varied compared to the wild type coding sequence or mRNA, such that they include an increased amount of G/C nucleotides while the translated amino acid sequence is retained. In respect to the fact that several codons code for one and the same amino acid (so-called degeneration of the genetic code), the most favourable codons for the stability can be determined (so-called alternative codon usage). Preferably, the G/C content of the coding region of the mRNA according to the invention is increased by at least 7%, more preferably by at least 15%, particularly preferably by at least 20%, compared to the G/C content of the coding region of the wild type RNA. According to a specific embodiment at least 5%, 10%, 20%, 30%, 40%, 50%, 60%, more preferably at least 70%, even more preferably at least 80% and most preferably at least 90%, 95% or even 100% of the substitutable codons in the region coding for a protein or peptide as defined herein or its fragment or variant thereof or the whole sequence of the wild type mRNA sequence or coding sequence are substituted, thereby increasing the G/C content of said sequence. In this context, it is particularly preferable to increase the G/C content of the mRNA to the maximum (i.e. 100% of the substitutable codons), in particular in the coding region, compared to the wild type sequence.

By a further embodiment, the inventive mRNA sequence preferably comprises at least one of the following structural elements: a 5'- and/or 3'-untranslated region element (UTR element), particularly a 5'-UTR element which comprises or consists of a nucleic acid sequence which is derived from the 5'-UTR of a TOP gene or from a fragment, homolog or a variant thereof, or a 5'- and/or 3'-UTR element which may be derivable from a gene that provides a stable mRNA or from a homolog, fragment or variant thereof; a histone stem-loop structure, preferably a histone stem-loop in its 3' untranslated region; a 5'-CAP structure; a poly-A tail (poly (A) sequence); or a poly(C) sequence as will be outlined in more detail below.

In a preferred embodiment the mRNA comprises at least one 5'- or 3'-UTR element. In this context an UTR element comprises or consists of a nucleic acid sequence which is derived from the 5'- or 3'-UTR of any naturally occurring gene or which is derived from a fragment, a homolog or a variant of the 5'- or 3'-UTR of a gene. Preferably, the 5'- or 3'-UTR element used according to the present invention is heterologous to the coding region of the inventive mRNA sequence. Even if 5'- or 3'-UTR elements derived from naturally occurring genes are preferred, also synthetically engineered UTR elements may be used in the context of the present invention.

In a particularly preferred embodiment the inventive mRNA sequence further comprises at least on 3'-UTR element which is derived from a 3'-UTR element of a gene, thereby providing a stabilization of the mRNA. Particularly preferred is a 3'-UTR element which comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

The term '3'-UTR element' refers to a nucleic acid sequence which comprises or consists of a nucleic acid sequence that is derived from a 3'-UTR or from a variant of a 3'-UTR. A 3'-UTR element in the sense of the present invention may represent the 3'-UTR of an mRNA. Thus, in the sense of the present invention, preferably, a 3'-UTR element may be the 3'-UTR of an mRNA, preferably of an artificial mRNA, or it may be the transcription template for a 3'-UTR of an mRNA. Thus, a 3'-UTR element preferably is a nucleic acid sequence which corresponds to the 3'-UTR of an mRNA, preferably to the 3'-UTR of an artificial mRNA, such as an mRNA obtained by transcription of a genetically engineered vector construct. Preferably, the 3'-UTR element fulfils the function of a 3'-UTR or encodes a sequence which fulfils the function of a 3'-UTR.

Preferably, the mRNA comprises a 3'-UTR element which may be derivable from a gene that relates to an mRNA with an enhanced half-life (that provides a stable mRNA), for example a 3'-UTR element as defined and described below.

In a particularly preferred embodiment, the 3'-UTR element comprises or consists of a nucleic acid sequence which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID NO: 1369-1390 of the patent application WO2013/143700 whose disclosure is incorporated herein by reference. In a particularly preferred embodiment, the 3'-UTR element comprises or consists of a nucleic acid sequence which is derived from a 3'-UTR of an albumin gene, preferably a vertebrate albumin gene, more preferably a mammalian albumin gene, most preferably a human albumin gene according SEQ ID NO: 1369 of the patent application WO2013/143700. The mRNA sequence may comprise or consist of a nucleic acid sequence which is derived from the 3'-UTR of the human albumin gene according to GenBank Accession number NM_000477.5, or from a fragment or variant thereof.

In this context it is particularly preferred that the inventive mRNA sequence comprises a 3'-UTR element comprising a corresponding RNA sequence derived from the nucleic acids according to SEQ ID NO: 1369-1390 of the patent application WO2013/143700 or a fragment, homolog or variant thereof.

Most preferably the 3'-UTR element comprises the nucleic acid sequence derived from a fragment of the human albumin gene according to SEQ ID NO: 1376 of the patent application WO2013/143700.

In another particularly preferred embodiment, the 3'-UTR element comprises or consists of a nucleic acid sequence which is derived from a 3'-UTR of an α-globin or β-globin gene, preferably a vertebrate α- or β-globin gene, more preferably a mammalian α- or β-globin gene, most preferably a human α- or β-globin gene according to SEQ ID NO: 1370 of the patent application WO2013/143700 (3'-UTR of *Homo sapiens* hemoglobin, alpha 1 (HBA1)), or according to SEQ ID NO: 1371 of the patent application WO2013/143700 (3'-UTR of *Homo sapiens* hemoglobin, alpha 2 (HBA2)), or according to SEQ ID NO: 1372 of the patent application WO2013/143700 (3'-UTR of *Homo sapiens* hemoglobin, beta (HBB)).

For example, the 3'-UTR element may comprise or consist of the center, α-complex-binding portion of the 3'-UTR of an α-globin gene, corresponding to SEQ ID NO: 1393 of the patent application WO2013/143700.

In this context it is particularly preferred that the 3'-UTR element of the inventive mRNA sequence comprises or consists of a corresponding RNA sequence of the nucleic acid sequence according to the above or a homolog, a fragment or variant thereof.

The term 'a nucleic acid sequence which is derived from the 3'-UTR of a [ . . . ] gene' preferably refers to a nucleic acid sequence which is based on the 3'-UTR sequence of a [ . . . ] gene or on a part thereof, such as on the 3'-UTR of an albumin gene, an α-globin gene, a β-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term 'a nucleic acid sequence which is derived from a variant of the 3'-UTR of a [ . . . ] gene' preferably refers to a nucleic acid sequence which is based on a variant of the 3'-UTR sequence of a gene, such as on a variant of the 3'-UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3'-UTR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

In especially preferred embodiments of the inventive mRNA sequence the 3'-UTR element is derived form a nucleic acid sequence according to SEQ ID NO: 3203 (3'-UTR of human albumin gene) or SEQ ID NO: 3199 (3'-UTR of α-globin gene) or from a corresponding RNA sequence, a homolog, a fragment of a variant thereof.

In a particularly preferred embodiment the mRNA sequence comprises at least one 5'-untranslated region element (5'-UTR element) which comprises or consists of a nucleic acid sequence which is derived from the 5'-UTR of a TOP gene or which is derived from corresponding RNA sequence, a fragment, homolog or variant of the 5'-UTR of a TOP gene, wherein it is particularly preferred that the 5'-UTR element does not comprise a TOP-motif or a 5'-TOP, as defined above.

In some embodiments, the nucleic acid sequence of the 5'-UTR element which is derived from a 5'-UTR of a TOP gene terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding region. Thus, preferably, the only protein coding part of the inventive mRNA is provided by the VP8* coding region and optionally further sequence sections as described above.

The nucleic acid sequence which is derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence which is derived from a nucleic acid sequence selected from the group consisting of SEQ ID NOs: 1-1363, SEQ ID NO: 1395, SEQ ID NO: 1421 and SEQ ID NO: 1422 of the patent application WO2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143700" refers to sequences of other species than *Homo sapiens*, which are homologous to the sequences according to SEQ ID NOs: 1-1363, SEQ ID NO: 1395, SEQ ID NO: 1421 and SEQ ID NO: 1422 of the patent application WO2013/143700.

In a preferred embodiment, the 5'-UTR element comprises or consists of a nucleic acid sequence which is derived from a nucleic acid sequence extending from nucleotide position 5 (i.e. the nucleotide that is located at position 5 in the sequence) to the nucleotide position immediately 5' to the start codon (located at the 3' end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700 from a variant thereof, or a corresponding RNA sequence. It is particularly preferred that the 5'-UTR element is derived from a nucleic acid sequence extending from the nucleotide position immediately 3' to the 5'-TOP to the nucleotide position immediately 5' to the start codon (located at the 3' end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700, from a variant thereof, or a corresponding RNA sequence.

In a particularly preferred embodiment, the 5'-UTR element comprises or consists of a nucleic acid sequence which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'-TOP motif. As described above, the sequence extending from position 5 to the nucleotide immediately 5' to the ATG (which is located at the 3'end of the sequences) corresponds to the 5'-UTR of said sequences. Preferably, the 5'-UTR element comprises or consists of a nucleic acid sequence which is derived from a 5'-UTR of a TOP gene encoding a ribosomal large protein (RPL) or from a homolog, a fragment or variant of a 5'-UTR of a TOP gene encoding a ribosomal large protein (RPL). For example, the 5'-UTR element comprises or consists of a nucleic acid sequence which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'-TOP motif.

In a particularly preferred embodiment, the 5'-UTR element comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'-TOP of said gene. A preferred sequence for a 5'-UTR element corresponds to SEQ ID NO: 1368 of the patent application WO2013/143700.

In a preferred embodiment of the inventive mRNA construct the 5'-UTR element is derived from a nucleic acid sequence according to SEQ ID NO: 3189 or from a corresponding RNA sequence, a homolog, a fragment or a variant thereof.

Accordingly, in a particularly preferred embodiment, the 5'-UTR element comprises or consists of a nucleic acid sequence which has an identity of at least about 20%, preferably of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence as mentioned above, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the inventive mRNA sequence comprises a 5'-UTR element which comprises or consists of a nucleic acid sequence which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NM E2, UQCRB, or from a homolog or variant thereof, wherein preferably the 5'-UTR element does not comprise a TOP-motif or the 5'-TOP of said genes, and wherein optionally the 5'-UTR element starts at its 5'-end with a nucleotide located at position 1, 2, 3, 4, 5, 6, 7, 8, 9 or 10 downstream of the 5' terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'-UTR element comprises or consists of a nucleic acid sequence which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit Vic gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit Vic gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit Vic gene (COX6C), or a mammalian N-acylsphingosine ami-dohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP syn-thase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit Vic gene (COX6C), or a human N-acylsphingosine amidohydrolase (acid ceramidase) 1 gene (ASAH1) or from a variant thereof, wherein preferably the 5'-UTR element does not comprise the 5'-TOP of said gene.

Accordingly, in a particularly preferred embodiment, the 5'-UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, or a corresponding RNA sequence, or wherein the at least one 5'-UTR element comprises or consists of a fragment of a nucleic acid sequence which has an identity of at least about 20%, preferably of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'-UTR element comprises or consists of a nucleic acid sequence which has an identity of at least about 20%, preferably of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according SEQ ID NO: 1414 of the patent application WO2013/143700 (5'-UTR of ATP5A1 lacking the 5' terminal oligopyrimidine tract) or preferably to a corresponding RNA sequence, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the at least one 5'-UTR element and the at least one 3'-UTR element act synergistically to increase protein production from the inventive mRNA sequence as described above.

In a particularly preferred embodiment, the inventive mRNA sequence comprises a histone stem-loop sequence/structure. Such histone stem-loop sequences are preferably selected from histone stem-loop sequences as disclosed in WO 2012/019780, whose disclosure is incorporated herewith by reference.

A histone stem-loop sequence, suitable to be used within the present invention, is preferably selected from at least one of the following formulae (I) or (II):

formula (I) (stem-loop sequence without stem bordering elements):

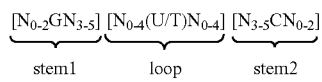

formula (II) (stem-loop sequence with stem bordering elements):

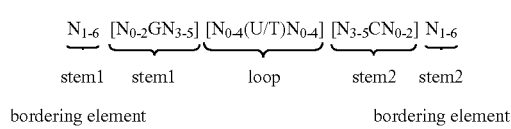

wherein:

| | |
|---|---|
| stem1 or stem2 bordering elements $N_{1-6}$ | is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof; |
| stem1 $[N_{0-2}GN_{3-5}]$ | is reverse complementary or partially reverse complementary with element stem2, and is a consecutive sequence between of 5 to 7 nucleotides; | wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine;

| | |
|---|---|
| loop sequence $[N_{0-4}(U/T)N_{0-4}]$ | is located between elements stem1 and stem2, and is a consecutive sequence of 3 to 5 nucleotides, more preferably of 4 nucleotides; | wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

| | |
|---|---|
| stem2 $[N_{3-5}CN_{0-2}]$ | is reverse complementary or partially reverse complementary with element stem1, and is a consecutive sequence between of 5 to 7 nucleotides; | wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine;

wherein stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one or more bases in one stem do not have a complementary base in the reverse complementary sequence of the other stem.

According to a further preferred embodiment of the first inventive aspect, the inventive mRNA sequence may comprise at least one histone stem-loop sequence according to at least one of the following specific formulae (Ia) or (IIa):

formula (Ia) (stem-loop sequence without stem bordering elements):

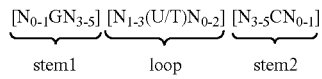

formula (IIa) (stem-loop sequence with stem bordering elements):

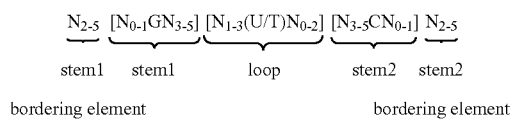

wherein N, C, G, T and U are as defined above.

According to a further more particularly preferred embodiment of the first aspect, the inventive mRNA sequence may comprise at least one histone stem-loop sequence according to at least one of the following specific formulae (Ib) or (IIb):

formula (Ib) (stem-loop sequence without stem bordering elements):

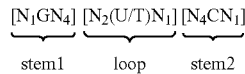

formula (IIb) (stem-loop sequence with stem bordering elements):

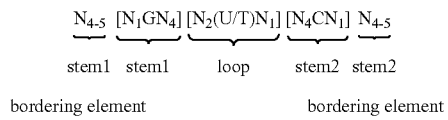

wherein N, C, G, T and U are as defined above.

In a preferred embodiment of the inventive mRNA sequence the histone stem-loop sequence is derived from a nucleic acid sequence according to SEQ ID NO: 3206 or from a corresponding RNA sequence (according to SEQ ID NO: 3207), a homolog, a fragment or a variant thereof.

In a particular preferred embodiment, the inventive mRNA sequence comprises, additionally to the rotavirus protein coding region and possibly further sequence sections, as described above, a poly(A) sequence, also called poly-A tail, preferably at the 3' terminus of the mRNA. When present, such a poly(A) sequence comprises a sequence of about 25 to about 400 adenosine nucleotides, preferably a sequence of about 50 to about 400 adenosine nucleotides, more preferably a sequence of about 50 to about 300 adenosine nucleotides, even more preferably a sequence of about 50 to about 250 adenosine nucleotides, most preferably a sequence of about 60 to about 250 adenosine nucleotides. In this context the term "about" refers to a deviation of ±10% of the value(s) it is attached to. Mostly preferred is a poly-A tail of 64 adenosine nucleotide. The poly(A) sequence is preferably located 3' of the coding region comprised in the mRNA according to the invention.

According to a further preferred embodiment, the inventive mRNA sequence can be modified by a sequence of at least 10 cytosines, preferably at least 20 cytosines, more preferably at least 30 cytosines (so-called "poly(C) sequence"). Particularly, the mRNA may contain a poly(C) sequence of typically about 10 to 200 cytosine nucleotides, preferably about 10 to 100 cytosine nucleotides, more preferably about 10 to 70 cytosine nucleotides or even more preferably about 20 to 50 or even 20 to 30 cytosine nucleotides. Mostly preferred is a poly(C) sequence of 30 cytosine nucleotides. The poly(C) sequence is preferably located 3' of the coding region, more preferably 3' of an optional poly(A) sequence comprised in the mRNA according to the present invention.

For further improvement of the resistance to e.g. in vivo degradation (e.g. by an exo- or endonuclease), the inventive mRNA sequence is provided as a stabilized nucleic acid, e.g. in the form of a modified nucleic acid. In this context the G/C content is preferably increased as outlined above. According to further preferred embodiments of the invention the mRNA is further stabilized, preferably by backbone modifications, sugar modifications and/or base modifications. All of these modifications may be introduced into the mRNA without impairing the mRNA's function to be translated in the host cell.

A backbone modification in the context of the present invention is preferably a modification in which phosphates of the backbone of the nucleotides contained in the mRNA are chemically modified, e.g. anionic internucleoside linkage, N3'→P5' modifications, replacement of non-bridging oxygen atoms by boranes, neutral internucleoside linkage, amide linkage of the nucleosides, methylene(methylimino) linkages, formacetal and thioformacetal linkages, introduction of sulfonyl groups, or the like.

A sugar modification in the context of the present invention is preferably a chemical modification of the sugar of the nucleotides of the mRNA, e.g. methylation of the ribose residue or the like.

Further details about the chemical modification of the RNA, especially the mRNA, will be apparent from the following, wherein the term "RNA modification" as used herein may refer to chemical modifications comprising sugar modifications, backbone modifications as well as base modifications or lipid modifications. In this context, a modified RNA molecule as defined herein may contain nucleotide analogues/modifications, e.g. backbone modifications, sugar modifications or base modifications. A backbone modification in connection with the present invention is a modification, in which phosphates of the backbone of the nucleotides contained in an RNA molecule as defined herein are chemically modified. A sugar modification in connection with the present invention is a chemical modification of the sugar of the nucleotides of the RNA molecule as defined herein. Furthermore, a base modification in connection with the present invention is a chemical modification of the base moiety of the nucleotides of the RNA molecule. In this context, nucleotide analogues or modifications are preferably selected from nucleotide analogues, which are applicable for transcription and/or translation.

The modified nucleosides and nucleotides, which may be incorporated into a modified RNA molecule as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH$_2$CH$_2$O)nCH$_2$CH$_2$OR; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified RNA molecule can include nucleotides containing, for instance, arabinose as the sugar.

The phosphate backbone may further be modified in the modified nucleosides and nucleotides, which may be incorporated into a modified RNA molecule as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

The modified nucleosides and nucleotides, which may be incorporated into a modified RNA molecule as described herein, can further be modified in the nucleobase moiety. Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, 06-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxoguanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-Thiophosphate)-Adenosine, 5'-O-(1-Thiophosphate)-Cytidine, 5'-O-(1-Thiophosphate)-Guanosine, 5'-O-(1-Thiophosphate)-Uridine or 5'-O-(1-Thiophosphate)-Pseudouridine.

In further specific embodiments, a modified RNA may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Further nucleotide analogues are such as those disclosed in WO2013/052523, WO2014093924 WO2015051173, WO2015/051169 and WO2015/089511.

According to a further embodiment, a modified RNA molecule as defined herein can contain a lipid modification. Such a lipid-modified RNA molecule typically comprises an RNA molecule as defined herein. Such a lipid-modified RNA molecule as defined herein typically further comprises at least one linker covalently linked with that RNA molecule, and at least one lipid covalently linked with the respective linker. Alternatively, the lipid-modified RNA molecule comprises at least one RNA molecule as defined herein and at least one (bifunctional) lipid covalently linked (without a linker) with that RNA molecule. According to a third alternative, the lipid-modified RNA molecule comprises an RNA molecule as defined herein, at least one linker covalently linked with that RNA molecule, and at least one lipid covalently linked with the respective linker, and also at least one (bifunctional) lipid covalently linked (without a linker) with that RNA molecule. In this context, it is particularly preferred that the lipid modification is present at the terminal ends of a linear RNA sequence.

According to another preferred embodiment of the invention, a modified RNA molecule as defined herein, can be modified by the addition of a so-called "5'-CAP" structure, namely by modification of the 5'-end of a RNA molecule.

A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. m7GpppN is the 5'-CAP structure which naturally occurs in mRNA transcribed by polymerase II and is therefore not considered as modification comprised in a modified RNA in this context. Accordingly, a modified RNA of the present invention may comprise a m7GpppN as 5'-CAP, but additionally the modified RNA comprises at least one further modification as defined herein.

Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-CAP structures are regarded as at least one modification in this context.

Particularly preferred modified 5'-cap structures are CAP1 (methylation of the ribose of the adjacent nucleotide of m7G), CAP2 (methylation of the ribose of the 2nd nucleotide downstream of the m7G), CAP3 (methylation of the ribose of the 3rd nucleotide downstream of the m7G), CAP4 (methylation of the ribose of the 4th nucleotide downstream of the m7G), ARCA (anti-reverse CAP analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine. According to a further preferred embodiment of the invention, the inventive mRNA sequence is optimized for translation, preferably optimized for translation by replacing codons for less frequent tRNAs of a given amino acid by codons for more frequently occurring tRNAs of the respective amino acid. This is based on the finding that the translation efficiency is also determined by a different frequency in the occurrence of tRNAs in cells. Thus, if so-called "less frequent codons" are present in the inventive mRNA to an increased extent, the corresponding modified RNA is translated to a significantly poorer degree than in the case where codons coding for more frequent tRNAs are present. Preferably, the coding region of the mRNA is modified compared to the corresponding region of the wild type RNA or coding sequence such that at least one codon of the wild type sequence which codes for a tRNA which is relatively rare or less frequent in the cell is exchanged for a codon which codes for a tRNA which is more or most frequent in the cell and carries the same amino acid as the relatively rare or less frequent tRNA. By this modification, the sequences of the mRNA can be modified such that codons for which more frequently occurring tRNAs are available are inserted. In other words, according to the invention, by this modification all codons of the wild type sequence which code for a tRNA which is relatively rare in the cell can in each case be exchanged for a codon which codes for a respective tRNA which is relatively frequent in the cell and which, in each case, carries the same amino acid as the relatively rare tRNA. Furthermore, it is particularly preferable to link the sequential G/C content which is increased, in particular maximized, in the mRNA with the "frequent" codons without modifying the amino acid sequence of the protein encoded by the coding region of the mRNA or of the coding region. This preferred embodiment allows provision of a particularly efficiently translated and stabilized (modified) mRNA.

Substitutions, additions or eliminations of bases are preferably carried out using a DNA matrix for preparation of the nucleic acid molecule by techniques of the well known site directed mutagenesis or with an oligonucleotide ligation. In such a process, for preparation of the inventive mRNA sequence as defined herein a corresponding DNA molecule may be transcribed in vitro. This DNA matrix preferably comprises a suitable promoter, e.g. a T7 or SP6 promoter, for in vitro transcription, which is followed by the desired nucleotide sequence for the at least one RNA to be prepared and a termination signal for in vitro transcription. The DNA molecule, which forms the matrix of the inventive mRNA sequence of interest, may be prepared by fermentative proliferation and subsequent isolation as part of a plasmid which can be replicated in bacteria. Plasmids which may be mentioned as suitable for the present invention are e.g. the plasmids pT7 Ts (GenBank accession number AB255037.1; Lai et al., Development 1995; 121:2349-2360), pGEM® series, e.g. pGEM®-1 (GenBank accession number X65300.1; from Promega) and pSP64 (GenBank accession number X65327.1); cf. also Mezei and Storts, Purification of PCR Products, in: Griffin and Griffin (ed.), PCR Technology: Current Innovation, CRC Press, Boca Raton, Fla., 2001.

The mRNA may be prepared using any method known in the art, including synthetic methods such as e.g. solid phase synthesis, as well as in vitro methods, such as in vitro transcription reactions.

In summary, in the context of the present invention, an mRNA is typically an RNA, which is composed of several structural elements, e.g. an optional 5'-CAP structure, an optional 5'-UTR region, an upstream positioned ribosomal binding site followed by a coding region, an optional 3'-UTR region, which may be followed by a poly-A tail (and/or a poly-C-tail). An mRNA may occur as a mono-, di-, or even multicistronic RNA, i.e. a RNA which carries the VP8* coding region or repeats of the VP8* coding region, and optionally further sequence sections as described above. Such coding sequences in di-, or even multicistronic mRNA may be separated by at least one IRES sequence as described herein.

In particularly preferred embodiments of the invention the inventive mRNA sequence has the following structure, wherein the mRNA sequence comprises, preferably in 5'- to 3'-direction:
 a 5'-CAP structure, preferably m7GpppN;
 at least one coding region encoding at least one epitope of a protein, or a fragment, variant or derivative thereof, of a virus of the genus rotavirus;
 optionally a 3'-UTR element preferably comprising or consisting of a nucleic acid sequence which is derived from a α-globin gene, preferably comprising the corresponding RNA sequence of the nucleic acid sequence according to SEQ ID NO: 3205 or SEQ ID NO: 3199 or a homolog, a fragment or a variant thereof;
 a poly(A) sequence, preferably comprising 64 adenosines;
 optionally a poly(C) sequence, preferably comprising 30 cytosines; and
 optionally a histone-stem-loop, preferably comprising the corresponding RNA sequence to the nucleic acid sequence according to SEQ ID NO: 3207.

In a further particularly preferred embodiment of the invention the inventive mRNA sequence has the following structure, wherein the mRNA sequence comprises, preferably in 5'- to 3'-direction:
 a 5'-CAP structure, preferably m7GpppN;
 optionally a 5'-UTR element preferably comprising or consisting of a nucleic acid sequence which is derived from the 5'-UTR of a TOP gene, preferably comprising or consisting of the corresponding RNA sequence of the nucleic acid sequence according to SEQ ID NO: 3189 or a homolog, a fragment or a variant thereof;
 at least one coding region encoding at least one epitope of a protein, or a fragment, variant or derivative thereof, of a virus of the genus rotavirus;

optionally a 3'-UTR element preferably comprising or consisting of a nucleic acid sequence which is derived from a gene providing a stable mRNA, preferably comprising or consisting of the corresponding RNA sequence of a nucleic acid sequence according to SEQ ID NO: 3205 or SEQ ID NO: 3199 or a homolog, a fragment or a variant thereof;

a poly(A) sequence preferably comprising 64 adenosines;

optionally a poly(C) sequence, preferably comprising 30 cytosines; and optionally a histone-stem-loop, preferably comprising the corresponding RNA sequence of the nucleic acid sequence according to SEQ ID NO: 3207.

With respect to the at least one coding region encoding at least one epitope of a rotavirus protein it is referred to the above description. Preferably, the at least one coding region encodes respectively the VP8* protein of one or more rotavirus strains/serotypes(or fragments or variants thereof) and preferably further sequence sections as described above, especially at least one sequence section encoding a helper peptide and/or at least one sequence section encoding a signal peptide for co-translational transport and/or at least one sequence section encoding a factor for antigen clustering/VLP formation and/or at least one sequence section encoding a transmembrane domain and/or a sequence section encoding a linker peptide.

In especially preferred embodiments the at least one coding region encoding the at least one epitope of a rotavirus protein encodes VP8*, wherein preferably the mRNA sequence comprises at least one sequence according to any one of SEQ ID NOs: 828-3146 or 3306-3593 or a sequence that is at least 60% identical, more preferably at least 70% identical, more preferably at least 80% identical, more preferably at least 90% identical, more preferably at least 95% identical, or most preferably at least 99% identical to any one of the sequences according to SEQ ID NOs: 828-3146 or 3306-3593.

According to a main aspect of the invention the mRNA sequence as described above is prepared for use as a vaccine, wherein the vaccine is especially advantageous for use in prophylaxis and/or treatment of rotavirus infections.

Furthermore, the invention relates to a composition that comprises at least one mRNA (one or more mRNAs) comprising at least one of the mRNA sequences as defined above and optionally a pharmaceutically acceptable carrier. In this context a pharmaceutically acceptable carrier or vehicle is an agent which typically may be used within a pharmaceutical composition for facilitating administering of the components of the pharmaceutical composition to an individual. A pharmaceutically acceptable carrier or vehicle typically includes a liquid or non-liquid material, which is mixed with the component(s) of the inventive composition. If the components of the inventive composition are provided in liquid form, the carrier will typically be pyrogen-free water, isotonic saline or buffered aqueous solutions, e.g phosphate, citrate etc. buffered solutions. Ringer or Ringer-Lactate solution is particularly preferred as a liquid basis. It may be preferred that at least one of the components of the inventive composition is prepared for sustained and/or delayed release.

In a preferred embodiment of the composition according to the invention, the at least one mRNA according to the invention is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

According to a preferred embodiment, the at least one mRNA of the composition according to the present invention may be complexed with lipids to form one or more liposomes, lipoplexes, or lipid nanoparticles. Therefore, in one embodiment, the inventive composition comprises liposomes, lipoplexes, and/or lipid nanoparticles comprising the at least one mRNA.

Lipid-based formulations have been increasingly recognized as one of the most promising delivery systems for RNA due to their biocompatibility and their ease of large-scale production. Cationic lipids have been widely studied as synthetic materials for delivery of RNA. After mixing together, nucleic acids are condensed by cationic lipids to form lipid/nucleic acid complexes known as lipoplexes. These lipid complexes are able to protect genetic material from the action of nucleases and deliver it into cells by interacting with the negatively charged cell membrane. Lipoplexes can be prepared by directly mixing positively charged lipids at physiological pH with negatively charged nucleic acids.

Conventional liposomes consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 6:286).

Liposomes are colloidal lipid-based and surfactant-based delivery systems composed of a phospholipid bilayer surrounding an aqueous compartment. They may present as spherical vesicles and can range in size from 20 nm to a few microns. Cationic lipid-based liposomes are able to complex with negatively charged nucleic acids via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the genetic material is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9: 1833-1843).

Cationic liposomes have been traditionally the most commonly used non-viral delivery systems for oligonucleotides, including plasmid DNA, antisense oligos, and siRNA/small hairpin RNA-shRNA). Cationic lipids, such as DOTAP (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency. Furthermore, neutral lipid-based nanoliposomes for RNA delivery as e.g. neutral 1,2-dioleoyl-sn-glycero-3-phosphatidylcholine (DOPC)-based nanoliposomes were developed. (Adv Drug Deliv Rev. 2014 February; 66: 110-116.).

Therefore, in one embodiment the at least one mRNA of the composition according to the present invention is complexed with cationic lipids and/or neutral lipids and thereby forms liposomes, lipid nanoparticles, lipoplexes or neutral lipid-based nanoliposomes.

In a preferred embodiment, the composition according to the invention comprises the mRNA comprising at least one mRNA sequence according to the invention that is formulated together with a cationic or polycationic compound and/or with a polymeric carrier. Accordingly, in a further embodiment of the invention, it is preferred that the mRNA as defined herein or any other nucleic acid comprised in the inventive (pharmaceutical) composition or vaccine is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of mRNA or nucleic acid to cationic or polycationic compound and/or with a polymeric carrier; or optionally in a nitrogen/phosphate (N/P) ratio of mRNA or nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one mRNA to the one or more polycations is in the range of about 0.1 to 10, including a range of about 0.3 to 4, of about 0.5 to 2, of about 0.7 to 2 and of about 0.7 to 1.5.

Therein, the mRNA as defined herein or any other nucleic acid comprised in the (pharmaceutical) composition or vaccine according to the invention can also be associated with a vehicle, transfection or complexation agent for increasing the transfection efficiency and/or the immunostimulatory properties of the mRNA according to the invention or of optionally comprised further included nucleic acids.

In a particularly preferred embodiment of the composition the at least one mRNA is at least partially associated with or complexed (formulated) with a cationic or polycationic compound and/or a polymeric carrier. Cationic compounds being particularly preferred agents in this context include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, proline-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, pIsI, FGF, Lactoferrin, Transportan, Buforin-2, Bac715-24, SynB, SynB(1), pVEC, hCT-derived peptides, SAP, or histones. Protamine is particularly preferred. Nevertheless, it is also possible that the mRNA of the inventive composition is naked or the composition comprises a mixture of naked and complexed mRNA.

Additionally, preferred cationic or polycationic proteins or peptides may be selected from the following proteins or peptides having the following total formula (III):

$(Arg)_l;(Lys)_m;(His)_n;(Orn)_o;(Xaa)_x,$ (formula (III))

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. Arg7, Arg8, Arg9, H3R9, R9H3, H3R9H3, YSSR9SSY, (RKH)4, Y(RKH)2R, etc. In this context the disclosure of WO 2009/030481 is incorporated herewith by reference.

Further preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl) diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl] trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

According to a preferred embodiment, the composition of the present invention comprises the mRNA as defined herein and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO 2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable of complexing the mRNA as defined herein or a further nucleic acid comprised in the composition, and thereby preferably condensing the mRNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the mRNA according to the invention or any further nucleic acid comprised in the (pharmaceutical) composition or vaccine of the present invention contains at least one -SH moiety, most preferably at least one cysteine residue or any further chemical group exhibiting an -SH moiety, capable of forming a disulfide linkage upon condensation with at least one further cationic or polycationic protein, peptide or polymer as cationic component of the polymeric carrier as mentioned herein.

As defined above, the polymeric carrier, which may be used to complex the mRNA of the present invention or any further nucleic acid comprised in the (pharmaceutical) composition or vaccine according to the invention may be formed by disulfide-crosslinked cationic (or polycationic) components. Preferably, such cationic or polycationic peptides or proteins or polymers of the polymeric carrier, which comprise or are additionally modified to comprise at least one -SH moiety, are selected from, proteins, peptides and polymers as defined herein for complexation agent.

In a further particular embodiment, the polymeric carrier which may be used to complex the RNA as defined herein or any further nucleic acid comprised in the (pharmaceutical) composition or vaccine according to the invention may be selected from a polymeric carrier molecule according to generic formula (IV):

  formula (IV)

wherein,

P$^1$ and P$^3$ are different or identical to each other and represent a linear or branched hydrophilic polymer chain, each P$^1$ and P$^3$ exhibiting at least one -SH-moiety, capable to form a disulfide linkage upon condensation with component P$^2$, or alternatively with (AA), (AA)$_x$, or [(AA)$_x$]$_z$ if such components are used as a linker between P$^1$ and P$^2$ or P$^3$ and P$^2$) and/or with further components (e.g. (AA), (AA)$_x$, [(AA)$_x$]$_z$ or L), the linear or branched hydrophilic polymer chain selected independent from each other from polyethylene glycol (PEG), poly-N-(2-hydroxypropyl) methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

P$^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a cationic or polycationic polymer, e.g. as defined above for the polymeric carrier formed by disulfide-cross-linked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each $P^2$ exhibiting at least two -SH-moieties, capable to form a disulfide linkage upon condensation with further components $P^2$ or component(s) $P^1$ and/or $P^3$ or alternatively with further components (e.g. (AA), (AA)$_x$, or [(AA)$_x$]Z); -S-S- is a (reversible) disulfide bond (the brackets are omitted for better readability), wherein S preferably represents sulphur or a -SH carrying moiety, which has formed a (reversible) disulfide bond. The (reversible) disulfide bond is preferably formed by condensation of -SH-moieties of either components $P^1$ and $P^2$, $P^2$ and $P^2$, or $P^2$ and $P^3$, or optionally of further components as defined herein (e.g. L, (AA), (AA)$_x$, [(AA)$_x$]z, etc); The -SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO 2011/026641 is incorporated herewith by reference. Each of hydrophilic polymers P1 and P3 typically exhibits at least one -SH-moiety, wherein the at least one -SH-moiety is capable to form a disulfide linkage upon reaction with component P2 or with component (AA) or (AA)$_x$, if used as linker between P1 and P2 or P3 and P2 as defined below and optionally with a further component, e.g. L and/or (AA) or (AA)$_x$, e.g. if two or more -SH-moieties are contained. The following subformulae "P1-S-S-P2" and "P2-S-S-P3" within generic formula (IV) above (the brackets are omitted for better readability), wherein any of S, P1 and P3 are as defined herein, typically represent a situation, wherein one-SH-moiety of hydrophilic polymers P1 and P3 was condensed with one -SH-moiety of component P2 of generic formula (IV) above, wherein both sulphurs of these -SH-moieties form a disulfide bond -S-S- as defined herein in formula (IV). These -SH-moieties are typically provided by each of the hydrophilic polymers P1 and P3, e.g. via an internal cysteine or any further (modified) amino acid or compound which carries a -SH moiety. Accordingly, the subformulae "P1-S-S-P2" and "P2-S-S-P3" may also be written as "P1-Cys-Cys-P2" and "P2-Cys-Cys-P3", if the -SH— moiety is provided by a cysteine, wherein the term Cys-Cys represents two cysteines coupled via a disulfide bond, not via a peptide bond. In this case, the term "-S-S-" in these formulae may also be written as "-S-Cys", as "-Cys-S" or as "-Cys-Cys-". In this context, the term "-Cys-Cys-" does not represent a peptide bond but a linkage of two cysteines via their -SH-moieties to form a disulfide bond. Accordingly, the term "-Cys-Cys-" also may be understood generally as "-(Cys-S)-(S-Cys)-", wherein in this specific case S indicates the sulphur of the -SH-moiety of cysteine. Likewise, the terms "-S-Cys" and "-Cys-S" indicate a disulfide bond between a -SH containing moiety and a cysteine, which may also be written as "-S-(S-Cys)" and "-(Cys-S)-S". Alternatively, the hydrophilic polymers P1 and P3 may be modified with a -SH moiety, preferably via a chemical reaction with a compound carrying a -SH moiety, such that each of the hydrophilic polymers P1 and P3 carries at least one such -SH moiety. Such a compound carrying a -SH moiety may be e.g. an (additional) cysteine or any further (modified) amino acid, which carries a -SH moiety. Such a compound may also be any non-amino compound or moiety, which contains or allows to introduce a -SH moiety into hydrophilic polymers P1 and P3 as defined herein. Such non-amino compounds may be attached to the hydrophilic polymers P1 and P3 of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β-unsatured carbonyls, etc), by click chemistry (e.g. azides or alkines), by alkene/alkine methathesis (e.g. alkenes or alkines), imine or hydrozone formation (aldehydes or ketons, hydrazins, hydroxylamins, amines), complexation reactions (avidin, biotin, protein G) or components which allow Sn-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers P1 and P3. As defined herein, each of hydrophilic polymers P1 and P3 typically exhibits at least one -SH-moiety preferably at one terminal end, but may also contain two or even more -SH-moieties, which may be used to additionally attach further components as defined herein, preferably further functional peptides or proteins e.g. a ligand, an amino acid component (AA) or (AA)x, antibodies, cell penetrating peptides or enhancer peptides (e.g. TAT, KALA), etc.

In this context it is particularly preferred to select the peptide sequence according to SEQ ID No. 3594 as P2.

Preferably, the inventive composition comprises at least one mRNA as defined herein, which is complexed with one or more polycations, and at least one free mRNA, wherein the at least one complexed mRNA is preferably identical to the at least one free mRNA. In this context, it is particularly preferred that the composition of the present invention comprises the mRNA according to the invention that is complexed at least partially with a cationic or polycationic compound and/or a polymeric carrier, preferably cationic proteins or peptides. In this context, the disclosure of WO 2010/037539 and WO 2012/113513 is incorporated herewith by reference. Partially means that only a part of the mRNA as defined herein is complexed in the composition according to the invention with a cationic compound and that the rest of the mRNA as defined herein is (comprised in the inventive (pharmaceutical) composition or vaccine) in uncomplexed form ("free"). Preferably, the molar ratio of the complexed mRNA to the free mRNA is selected from a molar ratio of about 0.001:1 to about 1:0.001, including a ratio of about 1:1. More preferably the ratio of complexed mRNA to free mRNA (in the (pharmaceutical) composition or vaccine of the present invention) is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed mRNA to free mRNA in the inventive pharmaceutical composition or vaccine is selected from a ratio of about 1:1 (w/w).

The complexed mRNA in the (pharmaceutical) composition or vaccine according to the present invention, is preferably prepared according to a first step by complexing the mRNA according to the invention with a cationic or polycationic compound and/or with a polymeric carrier, preferably as defined herein, in a specific ratio to form a stable complex. In this context, it is highly preferable, that no free cationic or polycationic compound or polymeric carrier or only a negligibly small amount thereof remains in the component of the complexed mRNA after complexing the mRNA. Accordingly, the ratio of the mRNA and the cationic or polycationic compound and/or the polymeric carrier in the component of the complexed RNA is typically selected in a range so that the mRNA is entirely complexed and no free cationic or polycationic compound or polymeric carrier or only a negligibly small amount thereof remains in the composition.

In other embodiments, the composition according to the invention comprising the mRNA as defined herein may be administered naked without being associated with any further vehicle, transfection or complexation agent.

It has to be understood and recognized, that according to the present invention, the inventive composition may comprise at least one naked mRNA as defined herein and/or at least one formulated/complexed mRNA as defined herein, wherein every formulation and/or complexation as disclosed above may be used.

In an especially preferred embodiment of the inventive composition the mRNA sequence encoding a rotavirus protein is combined with at least one VLP (virus like particle) forming protein or peptide or a fragment, variant or derivative thereof. Additionally or alternatively the mRNA sequence encoding a rotavirus protein is combined with a nucleic acid molecule, preferably an mRNA sequence, encoding a VLP forming protein or peptide or a fragment, variant or derivative thereof. In this context it is preferred that the mRNA sequence encoding at least one epitope of a rotavirus protein (e.g. VP8*) is fused to a transmembrane domain of a protein, or a fragment, variant or derivative thereof (e.g. transmembrane domain of Influenza HA) resulting in a membrane-bound form of the rotavirus protein. More preferably the mRNA sequence encoding the rotavirus protein additionally comprises a sequence section encoding a signal peptide as described above. A preferred construct may comprise in 5'-3' direction sequence sections coding for a signal peptide, VP8* and a transmembrane domain. This embodiment of the inventive composition, namely a combination of an mRNA construct encoding the rotavirus protein and at least one mRNA construct encoding a VLP forming protein or peptide, leads to co-expression of the membrane-bound rotavirus protein and the at least one VLP forming protein or peptide allowing formation of virus like particles thereby further increasing immune responses by antigen clustering.

The co-expression may be implemented in one single multicistronic mRNA construct or in at least two separated mRNA constructs.

In an especially preferred embodiment of this aspect of the invention the VLP forming protein or peptide is a viral matrix protein, or a fragment or derivative thereof, derived from an enveloped virus. The co-expression of such VLP forming proteins or peptides with the membrane-bound rotavirus protein advantageously results in the formation of VLPs with a lipid envelope. In preferred embodiments the matrix protein is a gag protein derived from an enveloped virus selected from HIV-1, EIAV, and MLV. In further preferred embodiments, the matrix protein is the matrix protein of vesiclular stomatitis virus (VSV), Rabies virus or the VP40 protein derived from an Ebola virus. Preferably the VLP forming protein is selected from any of the sequences according to SEQ ID Nos. 3172-3173.

Moreover, the invention relates to a pharmaceutical composition that comprises the composition as defined above, preferably in combination with a pharmaceutically acceptable carrier and/or vehicle.

The inventive pharmaceutical composition may be administered in various ways. Generally, the inventive pharmaceutical composition may be administered orally, parenterally, by inhalation spray, topically, rectally, nasally, buccally, vaginally or via an implanted reservoir. The term parenteral as used herein includes subcutaneous, intravenous, intramuscular, intraarticular, intranodal, intrasynovial, intrasternal, intrathecal, intrahepatic, intralesional, intracranial, transdermal, intradermal, intrapulmonal, intraperitoneal, intracardial, intraarterial, and sublingual injection or infusion techniques.

Preferably, the inventive pharmaceutical composition may be administered by parenteral injection, more preferably by subcutaneous, intravenous, intramuscular, intraarticular, intranodal, intrasynovial, intrasternal, intrathecal, intrahepatic, intralesional, intracranial, transdermal, intradermal, intrapulmonal, intraperitoneal, intracardial, intraarterial, and sublingual injection or via infusion techniques. Particularly preferred is intradermal and intramuscular injection. In one particularly preferred embodiment, the pharmaceutical composition is administered intramuscularly.

Methods for intramuscular administration are known in the art. Typically, a liquid is injected into a skeletal muscle (such as M. gluteus, M. deltoideus or M. vastus lateralis) using, for example, a syringe or a needle-free injection system, such as a jet injection system. Jet injection refers to a needle-free injection method, wherein a fluid comprising the inventive composition and, optionally, further suitable excipients is forced through an orifice, thus generating an ultra-fine liquid stream of high pressure that is capable of penetrating mammalian skin. In principle, the liquid stream forms a hole in the skin, through which the liquid stream is pushed into the target tissue.

Sterile injectable forms of the inventive pharmaceutical composition may be aqueous or oleaginous suspension. These suspensions may be formulated according to techniques known in the art using suitable dispersing or wetting agents and suspending agents. The sterile injectable preparation may also be a sterile injectable solution or suspension in a non-toxic parenterally-acceptable diluent or solvent, for example as a solution in 1,3-butanediol. Among the acceptable vehicles and solvents that may be employed are water, Ringer's solution and isotonic sodium chloride solution. In addition, sterile, fixed oils are conventionally employed as a solvent or suspending medium. For this purpose, any bland fixed oil may be employed including synthetic mono- or di-glycerides. Fatty acids, such as oleic acid and its glyceride derivatives are useful in the preparation of injectables, as are natural pharmaceutically-acceptable oils, such as olive oil or castor oil, especially in their polyoxyethylated versions. These oil solutions or suspensions may also contain a long-chain alcohol diluent or dispersant, such as carboxymethyl cellulose or similar dispersing agents that are commonly used in the formulation of pharmaceutically acceptable dosage forms including emulsions and suspensions. Other commonly used surfactants, such as Tweens, Spans and other emulsifying agents or bioavailability enhancers which are commonly used in the manufacture of pharmaceutically acceptable solid, liquid, or other dosage forms may also be used for the purposes of formulation of the inventive pharmaceutical composition.

Moreover, the inventive pharmaceutical composition as defined herein may also be administered orally in any orally acceptable dosage form including, but not limited to, capsules, tablets, aqueous suspensions or solutions. In the case of tablets for oral use, carriers commonly used include lactose and corn starch. Lubricating agents, such as magnesium stearate, are also typically added. For oral administration in a capsule form, useful diluents include lactose and dried cornstarch. When aqueous suspensions are required for oral use, the active ingredients are combined with emulsifying and suspending agents. If desired, certain sweetening, flavoring or coloring agents may also be added.

In a particularly preferred embodiment the inventive pharmaceutical composition is administered topically. For topical applications, the inventive pharmaceutical composition may be formulated in a suitable ointment, containing the component(s) of the inventive composition suspended or dissolved in one or more carriers. Carriers for topical administration include, but are not limited to, mineral oil, liquid petrolatum, white petrolatum, propylene glycol, polyoxyethylene, polyoxypropylene compound, emulsifying wax and water. Alternatively, the inventive pharmaceutical composition can be formulated in a suitable lotion or cream. In the context of the present invention, suitable carriers include, but are not limited to, mineral oil, sorbitan monostearate, polysorbate 60, cetyl esters wax, cetearyl alcohol, 2-octyldodecanol, benzyl alcohol and water. In especially preferred embodiments of the inventive composition enhancers for topical administration may be added to the composition, particularly substances which enhance skin permeability.

Moreover, transdermal administration may be preferred. In an especially preferred embodiment the pharmaceutical composition is prepared in the form of a transdermal patch, e.g. a microneedle patch (solid, hollow or dissolving), and the composition optionally comprises enhancers for transdermal delivery. Dermal or transdermal patches are particularly advantageous for slow release of the component(s) of the inventive composition.

In an especially preferred embodiment of the invention the inventive composition or the inventive pharmaceutical composition is provided or used as a vaccine. Therefore, the invention also relates to a vaccine comprising or consisting of a composition or pharmaceutical composition as defined above. Typically, such a vaccine is as defined above for pharmaceutical compositions. In the specific context of the inventive vaccine, the choice of a pharmaceutically acceptable carrier is determined in principle by the manner in which the inventive vaccine is administered. Routes for local administration in general include, for example, topical administration routes but also intradermal, transdermal, subcutaneous, or intramuscular injections or intralesional, intracranial, intrapulmonal, intracardial, and sublingual injection. Inventive vaccines are therefore preferably formulated in liquid (or sometimes in solid) form. Preferably, the inventive vaccine may be administered by conventional needle injection or needle-free jet injection. In a preferred embodiment the inventive vaccine may be administered by topical or transdermal routes.

According to another embodiment, the (pharmaceutical) composition or vaccine according to the invention may comprise an adjuvant, which is preferably added in order to enhance the immunostimulatory properties of the composition. In this context, an adjuvant may be understood as any compound, which is suitable to support administration and delivery of the composition according to the invention. Furthermore, such an adjuvant may, without being bound thereto, initiate or increase an immune response of the innate immune system, i.e. a non-specific immune response. In other words, when administered, the composition according to the invention typically initiates an adaptive immune response due to an antigen as defined herein or a fragment or variant thereof, which is encoded by the at least one coding region of the inventive mRNA contained in the composition of the present invention. Additionally, the composition according to the invention may generate an (supportive) innate immune response due to addition of an adjuvant as defined herein to the composition according to the invention.

Such an adjuvant may be selected from any adjuvant known to a skilled person and suitable for the present case, i.e. supporting the induction of an immune response in a mammal. Preferably, the adjuvant may be selected from the group consisting of, without being limited thereto, TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-β-D-glucopyranosyl)-N-octadecyl-dodecanoyl-amide hydroacetate); CALCITRIOL™ (1-alpha,25-dihydroxy-vitamin D3); calcium phosphate gel; CAP™ (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i) N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(b1-4)-N-acetylmuramyl-L-alanyl-D-isoglutamine); imiquimod (1-(2-methypropyl)-1H-imidazo[4,5-c]quinoline-4-amine); ImmTher™ (N-acetylglucosaminyl-N-acetylmuramyl-L-Ala-D-isoGlu-L-Ala-glycerol dipalmitate); DRVs (immunoliposomes prepared from dehydration-rehydration vesicles); interferon-gamma; interleukin-1beta; interleukin-2; interleukin-7; interleukin-12; ISCOMS™; ISCOPREP 70.0.3™; liposomes; LOXOR-IBINE™ (7-allyl-8-oxoguanosine); LT oral adjuvant (*E. coli* labile enterotoxin-protoxin); microspheres and microparticles of any composition; MF59™; (squalene-water emulsion); MONTANIDE ISA 51™ (purified incomplete Freund's adjuvant); MONTANIDE ISA 720™ (metabolisable oil adjuvant); MPL™ (3-Q-desacyl-4'-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ (@3-glucan); PLGA, PGA and PLA (homo- and co-polymers of lactic acid and glycolic acid; microspheres/nanospheres); PLURONIC L121™; PMMA (polymethyl methacrylate); PODDS™ (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, Ala.); STIMULON™ (QS-21); Quil-A (Quil-A saponin); S-28463 (4-amino-otec-dimethyl-2-ethoxymethyl-1H-imidazo[4,5 c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane© (2,6,10,15,19,23-hexamethyltetracosan and 2,6,10,15,19,23-hexamethyl-2,6,10,14,18,22-tetracosahexane); stearyltyrosine (octadecyltyrosine hydrochloride); Theramid® (N-acetylglucosaminyl-N-acetylmuramyl-L-Ala-D-isoGlu-L-Ala-dipalmitoxypropylamide); Theronyl-MDP (Termurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Particularly preferred, an adjuvant may be selected from adjuvants, which support induction of a Th1-immune response or maturation of naïve T-cells, such as GM-CSF, IL-12, IFN7, any immunostimulatory nucleic acid as defined herein, preferably an immunostimulatory RNA, CpG DNA, etc.

In a further preferred embodiment it is also possible that the inventive composition contains besides the antigen-providing mRNA further components which are selected from the group comprising: further antigens (e.g. in the form of a peptide or protein) or further antigen-encoding nucleic acids; a further immunotherapeutic agent; one or more auxiliary substances; or any further compound, which is known to be immunostimulating due to its binding affinity (as ligands) to human Toll-like receptors; and/or an adjuvant nucleic acid, preferably an immunostimulatory RNA (is-RNA).

The composition of the present invention can additionally contain one or more auxiliary substances in order to increase its immunogenicity or immunostimulatory capacity, if desired. A synergistic action of the mRNA as defined herein and of an auxiliary substance, which may be optionally contained in the inventive composition, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response to be enhanced and/or influenced in a targeted manner. Particularly preferred auxiliary substances are cytokines, such as monokines, lymphokines, interleukins or chemokines, that further promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL- 20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta or TNF-alpha, growth factors, such as hGH. A synergistic action of the mRNA contained in the inventive composition and of an auxiliary substance, which may be optionally be co-formulated (or separately formulated) with the inventive vaccine or composition as described above, is preferably achieved thereby. Preferably, such immunogenicity increasing agents or compounds are provided separately (not co-formulated with the inventive vaccine or composition) and administered individually.

Suitable adjuvants may also be selected from cationic or polycationic compounds wherein the adjuvant is preferably prepared upon complexing the mRNA of the composition according to the invention with the cationic or polycationic compound as disclosed above.

The inventive vaccine or composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to an inventive vaccine or composition in this context, may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

Suitable adjuvants may furthermore be selected from nucleic acids having the formula (Va): $G_lX_mG_n$, wherein: G is guanosine (guanine), uridine (uracil) or an analogue of guanosine (guanine) or uridine (uracil); X is guanosine (guanine), uridine (uracil), adenosine (adenine), thymidine (thymine), cytidine (cytosine) or an analogue of the above-mentioned nucleotides (nucleosides); l is an integer from 1 to 40, wherein when l=1 G is guanosine (guanine) or an analogue thereof, when l>1 at least 50% of the nucleotides are guanosine (guanine) or an analogue thereof; m is an integer and is at least 3; wherein when m=3 X is uridine (uracil) or an analogue thereof, when m>3 at least 3 successive uridines (uracils) or analogues of uridine (uracil) occur; n is an integer from 1 to 40, wherein when n=1 G is guanosine (guanine) or an analogue thereof, when n>1 at least 50% of the nucleotides (nucleosides) are guanosine (guanine) or an analogue thereof, or formula (Vb): $(N_uG_lX_mG_nN_v)_a$, wherein: G is guanosine (guanine), uridine (uracil) or an analogue of guanosine (guanine) or uridine (uracil), preferably guanosine (guanine) or an analogue thereof; X is guanosine (guanine), uridine (uracil), adenosine (adenine), thymidine (thymine), cytidine (cytosine), or an analogue of these nucleotides (nucleosides), preferably uridine (uracil) or an analogue thereof; N is a nucleic acid sequence having a length of about 4 to 50, preferably of about 4 to 40, more preferably of about 4 to 30 or 4 to 20 nucleic acids, each N independently being selected from guanosine (guanine), uridine (uracil), adenosine (adenine), thymidine (thymine), cytidine (cytosine) or an analogue of these nucleotides (nucleosides); a is an integer from 1 to 20, preferably from 1 to 15, most preferably from 1 to 10; l is an integer from 1 to 40, wherein when l=1, G is guanosine (guanine) or an analogue thereof, when l>1, at least 50% of these nucleotides (nucleosides) are guanosine (guanine) or an analogue thereof; m is an integer and is at least 3; wherein when m=3, X is uridine (uracil) or an analogue thereof, and when m>3, at least 3 successive uridines (uracils) or analogues of uridine (uracil) occur; n is an integer from 1 to 40, wherein when n=1, G is guanosine (guanine) or an analogue thereof, when n>1, at least 50% of these nucleotides (nucleosides) are guanosine (guanine) or an analogue thereof; u,v may be independently from each other an integer from 0 to 50, preferably wherein when u=0, v≥1, or when v=0, u≥1; wherein the nucleic acid molecule of formula (Vb) has a length of at least 50 nucleotides, preferably of at least 100 nucleotides, more preferably of at least 150 nucleotides, even more preferably of at least 200 nucleotides and most preferably of at least 250 nucleotides.

Other suitable adjuvants may furthermore be selected from nucleic acids having the formula (VI): $C_lX_mC_n$, wherein: C is cytidine (cytosine), uridine (uracil) or an analogue of cytidine (cytosine) or uridine (uracil); X is guanosine (guanine), uridine (uracil), adenosine (adenine), thymidine (thymine), cytidine (cytosine) or an analogue of the above-mentioned nucleotides (nucleosides); l is an integer from 1 to 40, wherein when l=1 C is cytidine (cytosine) or an analogue thereof, when l>1 at least 50% of the nucleotides are cytidine (cytosine) or an analogue thereof; m is an integer and is at least 3; wherein when m=3 X is uridine (uracil) or an analogue thereof, when m>3 at least 3 successive uridines (uracils) or analogues of uridine (uracil) occur; n is an integer from 1 to 40, wherein when n=1 C is cytidine (cytosine) or an analogue thereof, when n>1 at least 50% of the nucleotides (nucleosides) are cytidine (cytosine) or an analogue thereof.

In this context the disclosure of WO002008014979 and WO2009095226 is also incorporated herein by reference.

Further additives which may be included in the inventive vaccine or composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

In a further aspect, the present invention provides a vaccine, which is based on the mRNA sequence according to the invention comprising at least one coding region as defined herein. The vaccine according to the invention is preferably a (pharmaceutical) composition as defined herein. Accordingly, the vaccine according to the invention is based on the same components as the (pharmaceutical) composition described herein. Insofar, it may be referred to the description of the (pharmaceutical) composition as provided herein. Preferably, the vaccine according to the invention comprises at least one mRNA comprising at least one mRNA sequence as defined herein and a pharmaceutically acceptable carrier. In embodiments, where the vaccine comprises more than one mRNA sequence (such as a plurality of RNA sequences according to the invention, wherein each preferably encodes a distinct antigenic peptide or protein), the vaccine may be provided in physically separate form and may be administered by separate administration steps. The vaccine according to the invention may correspond to the (pharmaceutical) composition as described herein, especially where the mRNA sequences are provided by one single composition. However, the inventive vaccine may also be provided physically separated. For instance, in embodiments, wherein the vaccine comprises more than one mRNA sequences/species, these RNA species may be provided such that, for example, two, three, four, five or six separate compositions, which may contain at least one mRNA species/sequence each (e.g. three distinct mRNA species/sequences), each encoding distinct antigenic peptides or proteins, are provided, which may or may not be combined. Also, the inventive vaccine may be a combination of at least two distinct compositions, each composition comprising at least one mRNA encoding at least one of the antigenic peptides or proteins defined herein. Alternatively, the vaccine may be provided as a combination of at least one mRNA, preferably at least two, three, four, five, six or more mRNAs, each encoding one of the antigenic peptides or proteins defined herein. The vaccine may be combined to provide one single composition prior to its use or it may be used such that more than one administration is required to administer the distinct mRNA sequences/species encoding any of the antigenic peptides or proteins as defined herein. If the vaccine contains at least one mRNA sequence, typically at least two mRNA sequences, encoding the antigen combinations defined herein, it may e.g. be administered by one single administration (combining all mRNA species/sequences), by at least two separate administrations. Accordingly; any combination of mono-, bi- or multicistronic mRNAs encoding the at least one antigenic peptide or protein or any combination of antigens as defined herein (and optionally further antigens), provided as separate entities (containing one mRNA species) or as combined entity (containing more than one mRNA species), is understood as a vaccine according to the present invention. According to a particularly preferred embodiment of the inventive vaccine, the at least one antigen, preferably a combination as defined herein of at least two, three, four, five, six or more antigens encoded by the inventive composition as a whole, is provided as an individual (monocistronic) mRNA, which is administered separately.

As with the (pharmaceutical) composition according to the present invention, the entities of the vaccine may be provided in liquid and or in dry (e.g. lyophilized) form. They may contain further components, in particular further components allowing for its pharmaceutical use. The vaccine or the (pharmaceutical) composition may, e.g., additionally contain a pharmaceutically acceptable carrier and/or further auxiliary substances and additives and/or adjuvants.

The vaccine or (pharmaceutical) composition typically comprises a safe and effective amount of the mRNA according to the invention as defined herein, encoding an antigenic peptide or protein as defined herein or a fragment or variant thereof or a combination of antigens, preferably as defined herein. As used herein, "safe and effective amount" means an amount of the mRNA that is sufficient to significantly induce a positive modification of cancer or a disease or disorder related to cancer. At the same time, however, a "safe and effective amount" is small enough to avoid serious side-effects, that is to say to permit a sensible relationship between advantage and risk. The determination of these limits typically lies within the scope of sensible medical judgment. In relation to the vaccine or (pharmaceutical) composition of the present invention, the expression "safe and effective amount" preferably means an amount of the mRNA (and thus of the encoded antigen) that is suitable for stimulating the adaptive immune system in such a manner that no excessive or damaging immune reactions are achieved but, preferably, also no such immune reactions below a measurable level. Such a "safe and effective amount" of the mRNA of the (pharmaceutical) composition or vaccine as defined herein may furthermore be selected in dependence of the type of mRNA, e.g. monocistronic, bi- or even multicistronic mRNA, since a bi- or even multicistronic mRNA may lead to a significantly higher expression of the encoded antigen(s) than the use of an equal amount of a monocistronic mRNA. A "safe and effective amount" of the mRNA of the (pharmaceutical) composition or vaccine as defined above will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor. The vaccine or composition according to the invention can be used according to the invention for human and also for veterinary medical purposes, as a pharmaceutical composition or as a vaccine.

In a preferred embodiment, the mRNA of the (pharmaceutical) composition, vaccine or kit of parts according to the invention is provided in lyophilized form. Preferably, the lyophilized mRNA is reconstituted in a suitable buffer, advantageously based on an aqueous carrier, priorto administration, e.g. Ringer-Lactate solution, which is preferred, Ringer solution, a phosphate buffer solution. In a preferred embodiment, the (pharmaceutical) composition, the vaccine or the kit of parts according to the invention contains at least one, two, three, four, five, six or more mRNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of the (monocistronic) mRNAs.

The vaccine or (pharmaceutical) composition according to the invention may typically contain a pharmaceutically acceptable carrier. The expression "pharmaceutically acceptable carrier" as used herein preferably includes the liquid or non-liquid basis of the inventive vaccine. If the inventive vaccine is provided in liquid form, the carrier will be water, typically pyrogen-free water; isotonic saline or buffered (aqueous) solutions, e.g phosphate, citrate etc. buffered solutions. Particularly for injection of the inventive vaccine, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer. According to a more preferred embodiment, the buffer suitable for injection purposes as defined above, may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds may be used as well, which are suitable for administration to a person. The term "compatible" as used herein means that the constituents of the inventive vaccine are capable of being mixed with the mRNA according to the invention as defined herein, in such a manner that no interaction occurs, which would substantially reduce the pharmaceutical effectiveness of the inventive vaccine under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The choice of a pharmaceutically acceptable carrier is determined, in principle, by the manner, in which the pharmaceutical composition or vaccine according to the invention is administered. The composition or vaccine can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, composition or vaccines according to the present invention may be administered by an intradermal, subcutaneous, or intramuscular route, preferably by injection, which may be needle-free and/or needle injection. Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive composition or vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

Despite, the inventive composition may comprise further components for facilitating administration and uptake of components of the pharmaceutical composition. Such further components may be an appropriate carrier or vehicle, additional adjuvants for supporting any immune response, antibacterial and/or antiviral agents.

A further component of the inventive pharmaceutical composition may be an immunotherapeutic agent that can be selected from immunoglobulins, preferably IgGs, monoclonal or polyclonal antibodies, polyclonal serum or sera, etc. Preferably, such a further immunotherapeutic agent may be provided as a peptide/protein or may be encoded by a nucleic acid, preferably by a DNA or an RNA, more preferably an mRNA.

Further additives which may be included in the inventive composition are emulsifiers, such as, for example, Tween®; wetting agents, such as, for example, sodium lauryl sulfate; colouring agents; taste-imparting agents, pharmaceutical carriers; tablet-forming agents; stabilizers; antioxidants; preservatives.

The inventive composition and especially the pharmaceutical composition or vaccine typically comprises a "safe and effective amount" of the components of the composition, particularly of the mRNA sequence molecule(s) as defined herein. As used herein, a "safe and effective amount" means an amount of the mRNA molecule(s) as defined herein as such that is sufficient to significantly induce a positive protection or treatment of rotavirus disease. At the same time, however, a "safe and effective amount" is small enough to avoid serious side-effects and to permit a sensible relationship between advantage and risk. The determination of these limits typically lies within the scope of sensible medical judgment. A "safe and effective amount" of the components of the inventive pharmaceutical composition will furthermore vary in connection with the particular condition to be treated and also with the age and physical condition of the patient to be treated, the body weight, general health, sex, diet, time of administration, rate of excretion, drug combination, the severity of the condition, the duration of the treatment, the nature of the accompanying therapy, of the particular pharmaceutically acceptable carrier used, and similar factors, within the knowledge and experience of the accompanying doctor.

The inventive pharmaceutical composition may be used for human and also for veterinary medical purposes, preferably for human medical purposes, as a pharmaceutical composition in general or preferably as a vaccine or immunostimulating agent for prophylaxis and/or treatment of rotavirus infections.

Moreover, one or more compatible solid or liquid fillers or diluents or encapsulating compounds, which are suitable for administration to a patient to be treated, may be used as well for the pharmaceutical composition or vaccine according to the invention. The term "compatible" as used here means that these constituents of the inventive pharmaceutical composition or vaccine are capable of being mixed with the components of the inventive pharmaceutical composition or vaccine in such a manner that no interaction occurs which would substantially reduce the pharmaceutical effectiveness of the pharmaceutical composition or vaccine under typical use conditions.

Furthermore, the inventive pharmaceutical composition or vaccine may comprise at least one additional pharmaceutically active component. A pharmaceutically active component in this connection is a compound that has a therapeutic effect to heal, ameliorate or prevent a particular indication or disease. Such compounds include, without implying any limitation, peptides or proteins, preferably as defined herein, nucleic acids, preferably as defined herein, (therapeutically active) low molecular weight organic or inorganic compounds (molecular weight less than 5000, preferably less than 1000), sugars, antigens or antibodies, preferably as defined herein, therapeutic agents already known in the prior art, antigenic cells, antigenic cellular fragments, cellular fractions, cell wall components (e.g. polysaccharides), modified, attenuated or de-activated (e.g. chemically or by irradiation) pathogens (virus, bacteria etc.), antibacterial agents etc.

In a further aspect, the invention relates to a kit, preferably a kit of parts comprising one or more of the inventive mRNA sequence or the mRNA containing (pharmaceutical) composition or vaccine as described above, optionally a liquid vehicle for solubilising, and optionally technical instructions with information on the administration and dosage of the components respectively the composition or the pharmaceutical composition or the vaccine. Preferably, the mRNA component of the composition and possibly further components are provided in lyophilized form as a separate part. Preferably, the kit contains as a part Ringer-Lactate solution.

Beside the components of the inventive mRNA containing composition, the kit may additionally contain a pharmaceutically acceptable vehicle and/or one or more adjuvant components and optionally further components as described below, as well as means for administration and technical instructions. In a preferred embodiment, prior to use of the kit, the provided vehicle is than added to the lyophilized components in a predetermined amount as written e.g. in the provided technical instructions.

Moreover, the invention relates to the composition as defined above, or the pharmaceutical composition as defined above, or the vaccine as defined above, or the kit as defined above for use as a medicament and especially for use for the preparation of a medicament.

Moreover, the invention relates to a use of the composition as defined above, or the pharmaceutical composition as defined above, or the vaccine as defined above, or the kit as defined above for use in the treatment or prophylaxis of rotavirus infections. It is especially preferred to use the composition or the pharmaceutical composition or the vaccine or the kit in prophylaxis of rotavirus infections. It is especially preferred to use it as a prophylactic vaccine because the inventive vaccine is very efficient and safe and also cheap in production.

Preferably the composition as defined above, or the pharmaceutical composition as defined above, or the vaccine as defined above, or the kit as defined above is prepared for parenteral administration, more preferably for administration by subcutaneous or intramuscular or intradermal or topical or transdermal application. Compared to oral administration parenteral administration is particularly preferred because the efficiency or oral vaccination is significantly reduced in developing countries as already described above. Preferably, the administration is done by conventional needle injection or jet injection, preferably by using jet injection. For practical reasons in developing countries particularly conventional needle injection may be preferred, whereas also jet injection may be preferred, because it is an especially effective administration route. Nevertheless, other administration routes may also be applied, especially topical or transdermal administration may be applied, wherein the pharmaceutical composition or vaccine may be prepared in the form of a transdermal patch. The efficiency of the transdermal application may be enhanced by addition of enhancers for transdermal delivery.

Moreover, the invention relates to a method of treatment or prophylaxis of rotavirus infections, wherein one or more mRNA sequences or the composition or the pharmaceutical composition or the vaccine or the kit or kit of parts as defined above is provided and applied or administered to a tissue or an organism. Preferably, a therapeutically effective amount thereof is applied or administered to a subject in need thereof. In preferred embodiments the mRNA sequence(s) or the composition or the pharmaceutical composition or the vaccine or the kit or kit of parts is administered by subcutaneous or intramuscular or intradermal or topical or transdermal application, e. g. by conventional needle injection or jet injection.

Moreover, topical or transdermal administration may be especially preferred, for example by iontophoresis or by non-cavitational ultrasound or by cavitational ultrasound or by electroporation of by microneedles or by thermal ablation or by microdermabrasion. In this context it is referred to the article of Prausnitz M. R. and Langer R. (Prausnitz M. R. and Langer R. (2008), Nat Biotechnol November 26(11): 1261-1268) generally describing methods for transdermal drug delivery, which may be used for the inventive composition. It may be especially preferred to use transdermal patches for administration, as described above. Moreover, patches with microneedles may be used, especially for slow release. Moreover, in especially preferred embodiments, creams, lotions or gels containing the inventive composition may be used.

According to a specific embodiment, the inventive mRNA sequence(s), or the inventive (pharmaceutical) composition or vaccine may be administered to the patient as a single dose or as at least one single dose, respectively. In certain embodiments, the inventive mRNA sequence(s) or the inventive (pharmaceutical) composition or vaccine may be administered to a patient as a single dose followed by a second dose later and optionally even a third, fourth (or more) dose subsequent thereto etc. In accordance with this embodiment, booster inoculations with the inventive mRNA sequence(s) or the inventive (pharmaceutical) composition or vaccine may be administered to a patient at specific time intervals, preferably as defined below, following the second (or third, fourth, etc.) inoculation. Preferably, at least one dose of the inventive mRNA sequence, pharmaceutical composition or vaccine is administered, preferably from 1 to 10 doses, more preferably from 2 to 7 doses, even more preferably from 2 to 5 doses and most preferably from 3 to 5 doses. In a particularly preferred embodiment, 3 doses are administered. In another embodiment 5 doses are administered. In that embodiment, the doses are given in a specific time period, e.g. 20-30 or 20-60 days. The interval between the administration of two or more doses is preferably from 5 to 120 days, more preferably from 7 to 15 days or 15 to 30 days. In a preferred embodiment, the interval between the administration of two or more doses is at least 7 days, more preferably 28 days.

In a preferred embodiment, a single dose of the inventive mRNA sequence(s), composition or vaccine comprises a specific amount of the mRNA according to the invention. Preferably, the inventive mRNA sequence(s) is provided in an amount of at least 40 µg per dose, preferably in an amount of from 40 to 700 µg per dose, more preferably in an amount of from 80 to 400 µg per dose. More specifically, in the case of intradermal injection, which is preferably carried out by using a conventional needle, the amount of the inventive mRNA sequence(s) comprised in a single dose is typically at least 200 µg, preferably from 200 µg to 1.000 µg, more preferably from 300 µg to 850 µg, even more preferably from 300 µg to 700 µg. In the case of intradermal injection, which is preferably carried out via jet injection (e.g. using a Tropis device), the amount of the inventive mRNA sequence(s) comprised in a single dose is typically at least 80 µg, preferably from 80 µg to 700 µg, more preferably from 80 µg to 400 µg. Moreover, in the case of intramuscular injection, which is preferably carried out by using a conventional needle or via jet injection, the amount of the inventive mRNA sequence(s) comprised in a single dose is typically at least 80 µg, preferably from 80 µg to 1.000 µg, more preferably from 80 µg to 850 µg, even more preferably from 80 µg to 700 µg.

More specifically, the following specific embodiments are particularly preferred:

the inventive mRNA sequence(s), or the inventive (pharmaceutical) composition or vaccine is administered to the patient, preferably intradermally, in three doses (40 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intradermally, in three doses (80 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intradermally, in three doses (160 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intradermally, in three doses (320 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intradermally by jet injection, in three doses (40 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intradermally by jet injection, in three doses (80 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intradermally by jet injection, in three doses (160 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intradermally by jet injection, in three doses (320 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly, in three doses (40 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly in three doses (80 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly, in three doses (160 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly, in three doses (320 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly, in three doses (640 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly by jet injection, in three doses (40 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly by jet injection, in three doses (80 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly by jet injection, in three doses (160 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly by jet injection, in three doses (320 µg/dose), preferably within 20-60 days, e.g. on day 0, 7 and 28 or on day 0, 28 and 56 of the treatment.

the inventive mRNA sequence(s), or the inventive (pharmaceutical) composition or vaccine is administered to the patient, preferably intramuscularly by jet injection, in three doses (640 µg/dose), preferably within 20-60 days, e.g. on day 0, 7 and 28 or on day 0, 28 and 56 of the treatment.

In certain embodiments, such booster inoculations with the inventive mRNA sequence(s) or inventive (pharmaceutical) composition or vaccine as disclosed above (second, third etc. vaccination) may utilize an additional compound or component as defined for the inventive mRNA sequence(s) or inventive (pharmaceutical) composition or vaccine as defined herein.

In the present invention, if not otherwise indicated, different features of alternatives and embodiments may be combined with each other, where suitable. Furthermore, the term "comprising" shall not be narrowly construed as being limited to "consisting of" only, if not specifically mentioned. Rather, in the context of the present invention, "consisting of" is an embodiment specifically contemplated by the inventors to fall under the scope of "comprising", wherever "comprising" is used herein.

All publications, patents and patent applications cited in this specification are herein incorporated by reference as if each individual publication or patent application were specifically and individually indicated to be incorporated by reference. Although the foregoing invention has been described in some detail by way of illustration and example for purposes of clarity of understanding, it will be readily apparent to those of ordinary skill in the art in light of the teachings of this invention that certain changes and modifications may be made thereto without departing from the spirit or scope of the appended claims.

The examples and figures shown in the following are merely illustrative and shall describe the present invention in a further way. These figures and examples shall not be construed to limit the present invention thereto.

SHORT DESCRIPTION OF THE FIGURES

FIG. 1 Schematic drawings of preferred VP8* constructs. P2: P2 helper peptide from Tetanus toxin; VP8*: Virus protein 8* (cleavage product of rotavirus VP4 protein); SP:

signal peptide; WhcAg: Wodchuck Hepatitis virus core antigen; L: linker; TM: transmembrane domain FIG. 2 Humoral responses upon vaccination with the preferred constructs encoding the P2 VP8* protein.

- A: IgG1 and IgG2a antibody titers assessed by ELISA using P2 VP8* P[6] protein as a coating reagent. The experiment was performed as described in Example 2. Statistically significant IgG1 and IgG2a responses were detectable for most groups vaccinated with the mRNA vaccine encoding P2 VP8*. The best antibody responses were detectable in secreted and VLP designs. Each dot represents an individual animal and horizontal lines represent median values.
- B: IgG1 and IgG2a antibody titers assessed by ELISA using P2 VP8* P[4] protein as a coating reagent. The experiment was performed as described in Example 2. This figure shows cross-reactive responses in mice vaccinated with P[6] designs with P[4] serotype protein. Comparison of the different groups shows that the trend seen for P[6] coating remains unaltered. Each dot represents an individual animal and horizontal lines represent median values.
- C: IgG1 and IgG2a antibody titers assessed by ELISA using P2 VP8* P[8] protein as a coating reagent. The experiment was performed as described in Example 2. This figure shows cross-reactive responses in mice vaccinated with P[6] designs with P[8] serotype protein. Comparison of the different groups shows that the trend seen for P[6] and P[4] coating remains unaltered. Each dot represents an individual animal and horizontal lines represent median values.

EXAMPLES

The examples shown in the following are merely illustrative and shall describe the present invention in a further way. These examples shall not be construed to limit the present invention thereto.

Example 1: Preparation of the Rotavirus mRNA Vaccine

1. Preparation of DNA and mRNA Constructs

For the present examples DNA sequences encoding the VP8* protein of different serotypes of rotavirus were prepared and used for subsequent in vitro transcription. Schematics of the constructs are shown in FIG. 1.

2. In Vitro Transcription

The respective DNA plasmids prepared according to paragraph 1 were transcribed in vitro using T7 RNA polymerase in the presence of a CAP analogue (m7GpppG). Subsequently the mRNA was purified using PureMessenger© (CureVac, Tubingen, Germany; WO2008/077592A1).

The following mRNA sequences were prepared:

TABLE 21

| R number | SEQ ID NO. | Serotype | AA in VP4 | Helper peptide | Signal peptide | N glycosylation sites | Transmembrane domain | VLP domain |
|---|---|---|---|---|---|---|---|---|
| 1. R3718 | 3114 | P[6] | | +P2 | | N -> Q | | |
| 2. R3720 | 3135 | P[6] | | +P2 | | N -> Q | | |
| 3. R3722 | 3121 | P[6] | | +P2 | | N -> Q | | |
| 4. R3724 | 3128 | P[6] | | +P2 | | N -> Q | | WhcAg |
| 5. R5471 | 2968 | P[8] | 65-223 | +P2 | — | wt | | |
| 6. R5473 | 2872 | P[8] | 40-223 | +P2 | — | wt | | |
| 7. R5475 | 2488 | P[8] | 2-230 | +P2 | — | wt | | |
| 8. R5479 | 2484 | P[8] | 1-230 | — | — | wt | | |
| 9. R5481 | 2496 | P[8] | 2-230 | — | +HSA | wt | | |
| 10. R5483 | 2592 | P[8] | 10-223 | — | +HSA | wt | | |
| 11. R5485 | 2880 | P[8] | 40-223 | — | +HSA | wt | | |
| 12. R5487 | 2900 | P[8] | 40-223 | +P2 | +HSA | wt | | |
| 13. R5489 | 2904 | P[8] | 40-223 | +P2 | +IgE | wt | | |
| 14. R5491 | 2736 | P[8] | 10-240 | — | +HSA | N -> Q | | |
| 15. R5493 | 2928 | P[8] | 40-223 | — | +HSA | N -> Q | | |
| 16. R5594 | 2875 | P[6] | 40-223 | — | +HSA | wt | | |
| 17. R5595 | 2895 | P[6] | 40-223 | +P2 | +TPA | wt | | |
| 18. R5596 | 2491 | P[6] | 2-230 | — | +TPA | wt | | |
| 19. R5597 | 2827 | P[6] | 20-240 | — | +TPA | N -> Q | | |

The mRNA sequences comprise in 5'- to 3'-direction:
a) a 5'-CAP structure, consisting of m7GpppN;
b) a 5'-UTR element comprising the corresponding RNA sequence of the nucleic acid sequence according to SEQ ID NO: 3189;
c) at least one sequence encoding a signal peptide
d) optionally at least one sequence encoding at least one helper peptide (e.g. P2)
e) optionally at least one sequence encoding at least one protein enabling VLP formation (e.g. WHcAg)
f) at least one G/C optimized coding region encoding the protein of interest, preferably as shown in Table 2 Colums B,
g) a 3'-UTR element comprising the corresponding RNA sequence of a nucleic acid sequence according to SEQ ID NO: 3205;
h) a poly(A) sequence, comprising 64 adenosines;
i) a poly(C) sequence, comprising 30 cytosines; and
j) a histone-stem-loop structure, comprising the RNA sequence according to SEQ ID NO: 3207.

3. Preparation of the mRNA Vaccine 3.1. Protamine Complexation:

The mRNA vaccine consisted of a mixture of 50% free mRNA and 50% mRNA complexed with protamine at a weight ratio of 2:1. First, mRNA was complexed with protamine by addition of protamine-Ringer's lactate solution to mRNA. After incubation for 10 minutes, when the complexes were stably generated, free mRNA was added, and the final concentration of the vaccine was adjusted with Ringer's lactate solution.

3.2. LNP Formulation

Lipid nano particle (LNP)-formulated mRNA was generated using an ionizable amino lipid, phospholipid, cholesterol and a PEGylated lipid, similar in composition as described in Thess et al. Mol Ther J Am Soc Gene Ther. 2015; 23(9):1456-1464.

3.3. CVCM Formulation:

The polyethylene glycol/peptide polymers (HO-PEG 5000-S-(S-CHHHHHHRRRRHHHHHHC-S-)7-S-PEG 5000-OH according to formula IV (referred to as PB83) is used for complexation of the inventive mRNA sequences, optional in combination with a lipid or lipidoid as disclosed in PCT/EP2016/063228 (incorporated herewith by reference).

4. Analysis of VP8* Specific Antibodies by ELISA

ELISA plates were coated with 1 µg/ml (for P[4] P2-VP8* and P[6] P2-VP8*) or 10 µg/ml (for P[8] P2-VP8*) protein. Coated plates were blocked (in 1% milk; 0.05% Tween in PBS) and incubated with serum in different dilutions. Binding of specific antibodies to the P2 VP8* protein was detected using HRP (horse radish peroxidase) coupled rat monoclonal anti-mouse IgG1 or IgG2a using Amplex Ultra Red as a substrate for detection.

Statistical analysis was done by Mann Whitney test. Asterisks represent the following p values: *p<0.05; p<0.01; *p<0.001.

Example 2: Induction of Humoral Responses Upon Vaccination with the mRNA Vaccine Encoding the P2 VP8* Protein Balb/c mice were immunised with mRNA vaccines (as prepared in Example 1) encoding P2-VP8* from serotype P[6] or RiLa (Ringer lactate) as a negative control as indicated in Table 22 below. Intradermal (i.d.) vaccinations were performed on day 0, day 21 and day 42. Blood samples taken on day 56 were analysed for the presence of VP8* specific IgG1 and IgG2a antibodies by ELISA using P2 VP8* P[6] protein (FIG. 2 A), P2 VP8* P[4] protein (FIG. 2 B), or P2 VP8* P[8] protein (FIG. 2 C) as a coating reagent (Wen et al., 2014. Vaccine 32, 4420-4427).

TABLE 22

Animal groups and treatment

| | Strain/gender | Nr. | Treatment/Vaccine dose | Construct | Serotype | Route/Volume | Vaccin. schedule |
|---|---|---|---|---|---|---|---|
| 1 | BALB/c Female | 8 | 80 µg R3718 | Secreted P2-VP8* | P[6] | i.d. 2 × 50 µl | d0/21/42 |
| 2 | BALB/c Female | 8 | 80 µg R3720 | Secreted repeat P2-VP8* | P[6] | i.d. 2 × 50 µl | d0/21/42 |
| 3 | BALB/c Female | 8 | 80 µg R3722 | Transmembrane P2-VP8* | P[6] | i.d. 2 × 50 µl | d0/21/42 |
| 4 | BALB/c Female | 8 | 80 µg R3724 | VLP P2-VP8* | P[6] | i.d. 2 × 50 µl | d0/21/42 |
| 5 | BALB/c Female | 8 | 100% RiLa | — | — | i.d. 2 × 50 µl | d0/21/42 |

Results

As shown in FIG. 2 A, statistically significant IgG1 and IgG2a responses were detectable for most groups vaccinated with the mRNA vaccine encoding P2 VP8* when P2 VP8* of serotype P[6] protein was used as a coating reagent. The best antibody responses were detectable in secreted and VLP designs.

FIG. 2 B shows cross-reactive responses in mice vaccinated with P[6] designs with the P[4] serotype P2 VP8* protein used as a coating reagent. Comparison of the different groups shows that the trend seen for P[6] coating in FIG. 2 remains unaltered. This result is very surprising as cross-protection between different serotypes of rotavirus would not have been expected.

FIG. 2 C shows cross-reactive responses in mice vaccinated with P[6] designs with the P[8] serotype P2 VP8* protein used as a coating reagent. Comparison of the different groups shows that the trend seen for P[6] and P[4] coating in FIG. 2 A and FIG. 2 B, respectively, remains unaltered. This result is very surprising as cross-protection between different serotypes of rotavirus would not have been expected.

Example 3: Immunogenicity of New VP8* Designs

Balb/c mice are immunised intradermally with the new mRNA vaccine designs encoding P2-VP8* (table 21). RiLa (Ringer lactate) and adjuvanted P2-VP8* protein are employed as a negative and positive control, respectively, as indicated in Table 23 and 24. Vaccinations are performed on day 0, day 21 and day 42. Blood samples taken on day 56 are analysed for the presence of VP8* specific IgG1 and IgG2a antibodies by ELISA using P2 VP8* P[8] or P[6] protein, respectively, as a coating reagent as described above.

TABLE 23

Animal groups and treatment part A

| Gr. | Strain/ gender | Number | Treatment | Route/ Volume | Vaccin. schedule |
|---|---|---|---|---|---|
| 1 | BALB/c female | 6 | Negative control | i.d. 2 × 50 μl | d0/21/42 |
| 2 | BALB/c female | 6 | Positive control | i.m. 4 × 25 μl | d0/21/42 |
| 3 | BALB/c female | 12 | 80 μg R3718 | i.d. 2 × 50 μl | d0/21/42 |
| 4 | BALB/c female | 12 | 80 μg R5594 | i.d. 2 × 50 μl | d0/21/42 |
| 5 | BALB/c female | 12 | 80 μg R5595 | i.d. 2 × 50 μl | d0/21/42 |
| 6 | BALB/c female | 12 | 80 μg R5596 | i.d. 2 × 50 μl | d0/21/42 |
| 7 | BALB/c female | 12 | 80 μg R5597 | i.d. 2 × 50 μl | d0/21/42 |
| 8 | BALB/c female | 12 | 80 μg R5471 | i.d. 2 × 50 μl | d0/21/42 |
| 9 | BALB/c female | 12 | 80 μg R5473 | i.d. 2 × 50 μl | d0/21/42 |
| 10 | BALB/c female | 12 | 80 μg R5475 | i.d. 2 × 50 μl | d0/21/42 |
| 11 | BALB/c female | 12 | 80 μg R5479 | i.d. 2 × 50 μl | d0/21/42 |

TABLE 24

Animal groups and treatment part B

| Gr. | Strain/ gender | Number | Treatment | Route/ Volume | Vaccin. schedule |
|---|---|---|---|---|---|
| 1 | BALB/c Female | 6 | Negative control | i.d. 2 × 50 μl | d0/21/42 |
| 2 | BALB/c Female | 6 | Positive control | i.m. 4 × 25 μl | d0/21/42 |
| 3 | BALB/c Female | 12 | 80 μg R3718 | i.d. 2 × 50 μl | d0/21/42 |
| 4 | BALB/c Female | 12 | 80 μg R5481 | i.d. 2 × 50 μl | d0/21/42 |
| 5 | BALB/c Female | 12 | 80 μg R5483 | i.d. 2 × 50 μl | d0/21/42 |
| 6 | BALB/c Female | 12 | 80 μg R5485 | i.d. 2 × 50 μl | d0/21/42 |
| 7 | BALB/c Female | 12 | 80 μg R5487 | i.d. 2 × 50 μl | d0/21/42 |
| 8 | BALB/c Female | 12 | 80 μg R5489 | i.d. 2 × 50 μl | d0/21/42 |
| 9 | BALB/c Female | 12 | 80 μg R5490 | i.d. 2 × 50 μl | d0/21/42 |
| 10 | BALB/c Female | 12 | 80 μg R5491 | i.d. 2 × 50 μl | d0/21/42 |

Example 4: Immunogenicity of New VP8* Formulations

Five mRNA designs are tested as mRNA formulations with LNPs (lipid nanoparticle) and CVCMs formulations. For this, the respective mRNA sequences are formulated as described above and are tested upon intramuscular injection. RiLa (Ringer lactate) and adjuvanted P2-VP8* protein are employed as a negative and positive control, respectively, as indicated in Table 25 and 26 vaccinations are performed on day 0, day 21 and day 42. Blood samples taken on day 56 are analysed for the presence of VP8* specific IgG1 and IgG2a antibodies by ELISA using P2 VP8* P[8] or P[6] protein, respectively, as a coating reagent (FIG. 2)

TABLE 25

Animal groups and treatment LNP formulations

| Gr. | Strain/ gender | Number | Treatment | Vaccine formulation | Route/ Volume | Vaccin. schedule |
|---|---|---|---|---|---|---|
| 1 | BALB/c female | 6 | Negative control | — | i.d. 2 × 50 µl | d0/21/42 |
| 2 | BALB/c female | 6 | Positive control | — | i.m. 4 × 25 µl | d0/21/42 |
| 3 | BALB/c female | 12 | Design 1 80 µg | Protamine formulation | i.d. 2 × 50 µl | d0/21/42 |
| 4 | BALB/c female | 12 | Design 2 80 µg | Protamine formulation | i.d. 2 × 50 µl | d0/21/42 |
| 5 | BALB/c female | 12 | Design 3 80 µg | Protamine formulation | i.d. 2 × 50 µl | d0/21/42 |
| 6 | BALB/c female | 12 | Design 4 80 µg | Protamine formulation | i.d. 2 × 50 µl | d0/21/42 |
| 7 | BALB/c female | 12 | Design 5 80 µg | Protamine formulation | i.d. 2 × 50 µl | d0/21/42 |
| 8 | BALB/c female | 12 | Design 1 5 µg | LNP formulation | i.m. 1 × 25 µl | d0/21/42 |
| 9 | BALB/c female | 12 | Design 2 5 µg | LNP formulation | i.m. 1 × 25 µl | d0/21/42 |
| 10 | BALB/c female | 12 | Design 3 5 µg | LNP formulation | i.m. 1 × 25 µl | d0/21/42 |
| 11 | BALB/c female | 12 | Design 4 5 µg | LNP formulation | i.m. 1 × 25 µl | d0/21/42 |
| 12 | BALB/c female | 12 | Design 5 5 µg | LNP formulation | i.m. 1 × 25 µl | d0/21/42 |

TABLE 26

Animal groups and treatment CVCM formulations

| Gr. | Strain/ gender | Number | Treatment | Vaccine formulation | Route/ Volume | Vaccin. schedule |
|---|---|---|---|---|---|---|
| 1 | BALB/c female | 6 | Negative control | — | i.d. 2 × 50 µl | d0/21/42 |
| 2 | BALB/c female | 6 | Positive control | — | i.m. 4 × 25 µl | d0/21/42 |
| 3 | BALB/c female | 12 | Design 1 80 µg | Protamine formulation | i.d. 2 × 50 µl | d0/21/42 |
| 4 | BALB/c female | 12 | Design 2 80 µg | Protamine formulation | i.d. 2 × 50 µl | d0/21/42 |
| 5 | BALB/c female | 12 | Design 3 80 µg | Protamine formulation | i.d. 2 × 50 µl | d0/21/42 |
| 6 | BALB/c female | 12 | Design 4 80 µg | Protamine formulation | i.d. 2 × 50 µl | d0/21/42 |
| 7 | BALB/c female | 12 | Design 5 80 µg | Protamine formulation | i.d. 2 × 50 µl | d0/21/42 |
| 8 | BALB/c female | 12 | Design 1 10 µg | CVCM formulation | i.m. 1 × 25 µl | d0/21/42 |
| 9 | BALB/c female | 12 | Design 2 10 µg | CVCM formulation | i.m. 1 × 25 µl | d0/21/42 |
| 10 | BALB/c female | 12 | Design 3 10 µg | CVCM formulation | i.m. 1 × 25 µl | d0/21/42 |
| 11 | BALB/c female | 12 | Design 4 10 µg | CVCM formulation | i.m. 1 × 25 µl | d0/21/42 |
| 12 | BALB/c female | 12 | Design 5 10 µg | CVCM formulation | i.m. 1 × 25 µl | d0/21/42 |

SEQUENCE LISTING (3593 sequences)

SEQ ID NO: 1 - protein, 1088 aa, Artificial Sequence
  Rotavirus VP1
  misc_feature (708)..(708): Xaa can be any naturally occurring amino acid
MGKYNLILSEYLSFIYNSQSAVQIPIYYSSNSELESRCIEFHSKCLENSKNGLSLKKLFDEYSDVIKNATLLSILSYSYDKYNAVERKLVKYAKGKPLEADLTMNELDYENNKITSELFPTAEEYTDSLMDPAILTSLSSNLNAVMFWLEKHENDTAEKFKIYKRRLELFTIVASTINKYGVPRHNAKYRYEYDVMKDKPYYLVTWANSSIEMLMSVFSHEDYLIARELIVLSYSNRSTLAKLVSSPMSILVALVDINGTFITNEELELEFSNKYVRAIVPDQTFDELKQMINSMRKAGLVDIPKMIQDWLVDCSIEKFPLMAKIYSWSFHVGFRKQKMLDAALDQLKTEYTEDVDDEMYREYTMLIRDEVVKMLEESVKHDDHLLQDSELAGLLSMSSASNGESRQLKFGRKTVFSTKKNMHVMDDMANGRYTPGIIPPVNADKPIPLGRRDVPGRRTRIIFILPYEYFIAQHAVVEKMLIYAKHTREYAEFYSQSNQLLSYGDVTRFLSNNAMVLYTDVSQWDSSQHNTQPFRKGIIMGLDILANMTNDAKVIQTLNLYKQTQINLMDSYVQIPDGNVIKKIQYGAVASGEKQTKAANSIANLALIKTVLSRISNKYSFATKIIRVDGDDNYAVLQFNTEVTKQMVQDVSNDVRETYARMNAKVKALVSTVGIEIAKRYIAGGKIFFRAGINLLNNEKRGQSTQWXQAAVLYSNYIVNRLRGFETDREFILTKIMQMTSIAITGSLRLFPSERVLTTNSTFKVFDSEDFIIEYGTNDDEVYIQRAFMSLSSQRSGIADEIAASPTFKNYVSRLSEQLLFSRNNIVSRGIALTEKAKLNSYAPISLEKRRAQISALLTMLQKPVTFKSNKITINDILKDIKPFFTVSEAHLPIQYQKFMPTLPENVQYIIQCIGSRTYQIEDDGSKSAISRLISKYSVYKPSIEELYKVISLHENEIQLYLISLGIPKIDADTYVGSKIYSQDKYRILESYVYNLLSINYGCYQLFDFNSPDLEKLIRIPFKGKIPAVTFILHLYAKLEVINHAIKNGSWISLFCNYPKSEMIKLWKKMWNITSLRSPYTNANFFQD

SEQ ID NO: 2 - protein, 879 aa, Artificial Sequence
  Rotavirus VP2
MAYRKRGARREANLNNNDRMQEKIDEKQDSNKTQLSDKVLSKKEEVVTDSHEEVKITDEVKKSTKEESKQLLEVLKTKEEHQKEIQYEILQKTIPTFEPKETILRKLEDIKPELAKKQTKLFRIFEPKQLPIYRANGERELRNRWYWKLKKDTLPDGDYDVREYFLNLYDQVLTEMPDYLLLKDMAVENKNSRDAGKVVDSETASICDAIFQDEETEGAVRRFIAEMRQRVQADRNVVNYPSILHPIDYAFNEYFLQHQLVEPLNNDIIFNYIPERIRNDVNYILNMDRNLPSTARYIRPNLLQDRLNLHDNFESLWDTITTSNYILARSVVPDLKELVSTEAQIQKMSQDLQLEALTIQSETQFLTGINSQAANDCFKTLIAAMLSQRTMSLDFVTTNYMSLISGMWLLTVVPNDMFIRESLVACQLAIVNTIIYPAFGMQRMHYRNGDPQTPFHIAEQQIQNFQVANWLHFVNNNQFRQAVIDGVLNQVLNDNIRNGHVINQLMEALMQLSRQQFPTMPIDYKRSIQRGILLLSNRLGQLVDLTRLLAYNYETLMACITMNMQHVQTLTTEKLQLTSVTSLCMLIGNTTVIPSPQTLFHYYNVNVNFHSNYNERINDAVAIITAANRLNLYQKKMKAIVEDFLKRLYIFDVSRVPDDQMYRLRDRLRLLPVEIRRLDIFNLILMNMDQIERASDKIAQGVIIAYRDMHLERDEMYGYVNIARNLEGFQQINLEELMRSGDYAQITNMLLNNQPVALVGALPFITDSSVISLIAKLDATVFAQIVKLRKVDTLKPILYKINSDSNDFYLVANYDWVPTSTTKVYKQVPQQFDFRNSMHMLTSNLTFTVYSDLLAFVSADTVEPINAVAFDNMRIMNEL

SEQ ID NO: 3 - protein, 835 aa, Artificial Sequence
  Rotavirus VP3
MKVLALRHSVAQVYADTQVYTHDDSKDEYENAFLISNLTTHNILYLNYNVKTLQILNKSGIAAVEIQKIDELFTLIRCNFTYDYIDNVVYLHDYSYYTNNEIRTDQHWITKTNIEDYLLPGWKLTYVGYNGSDTRGHYNFSFRCQNAATDDDAIIEYIYSDELDFQSFILKKIKERMTTSLPIARLSNRVFRDKLFKTVSVNHDKVVNIGPRNESMFTFLDYPSIKQFSNGPYLVKDTIKLKQERWLGKRLSQFDIGQYKNMLNVLTTLYQYYDIYHEKPIIYMIGSAPSYWIYDVKQYSNLKFETWDPLDTPYSNLHHKELFYINDVQKLKDNSILYIDIRTDRGTVDWKEWRKIVERQTIDNLHIAYKYLSTGKAKVCCVKMTAMDLELPISAKLLHHPTTEIRSEFYLVMDIWDSKNIKRFIPKGVLYSYINNTITENVFIQQPFKLKTLKNEYIIALYALSNDLNNRENVVKLINNQKKALMTVRINNTFKDEPKIGFKNIYDWTFLPTDFETNESIITSYDGCLGIFGLSISLASKPTGNNHLFILSGTDKYFKLDQFANHMSISRRSHQIRFSESATSYSGYIFRDLSNNNFNLIGTNVENSVSGHVYNALIYYRYNYSFDLKRWIYLHSTGKASIEGGKYYEHAPIELIYACISAREFAKLQDDLTVLRYSNEIENYINKVYSITYADDPNYFIGIKFKNIPYKYNVKVPHLTFGVLNISEQMLPDVITILKRFKNELFRMEITTSYTYMLSDEVYVANISGVLSTYFKIYNAFYKEQITFGQSRMFIPHVTLSFSNEKTVRIDTTKLHIDSIYLRKIKGDTVFDMTG

SEQ ID NO: 4 - protein, 775 aa, Artificial Sequence
  Rotavirus VP4
MASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSRSIQYRRAQVNEDITISKTSLWKEMQYNRDIIIRFKFGNSVIKLGGLGYKWSEISYKAANYQYSYSRDGEQVTAHTTCSVNGVNNFSYNGGSLPTDFSISRYEVIKENSYVYIDYWDDSKAFRNMVYVRSLAANLNSVKCAGGSYDFRLPVGEWPIMNGGAVSLHFAGVTLSTQFTDFVSLNSLRFRFSLTVDEPSFSIIRTRTMNLYGLPAANPNNGNEYYEVSGRFSLISLVPTNDDYQTPIMNSVTVRQDLERQLNDLREEFNSLSQEIAMSQLIDLALLPLDMFSMFSGIKSTIDLTKSMATSVMKKFRKSKLATSISEMTNSLSDAASSASRSASIRSNLSAISNWSDASKSVLNVTDSLNDVSTQTSTISKKLRLKEMITQTEGINFDDISAAVLKTKMDMSTQIGKNTLPDIVTEASEKFIPKRSYRVLKDDEVMEVNTEGKFFAYKVDTLNEIPFDINKFAELVTDSPVISAIIDFKTLKNLNDNYGITRIEALDLIKSNPNVLRNFINQNNPIIRNRIEQLILQCKL

SEQ ID NO: 5 - protein, 775 aa, Artificial Sequence
  Rotavirus VP4
MASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSRSVTYQRAQVNEDIIISKTSLWKEMQYNRDIIIRFKFNNSIVKLGGLGYKWSEISFKAANYQYNYLRDGEQVTAHTTCSVNGVNNFSYNGGSLPTDFSVSRYEVIKENSYVYVDYWDDSQAFRNMVYVRSLAANLNSVKCSGGNYNFQIPVGAWPVMSGGAVSLHFAGVTLSTQFTDFVSLNSLRFRFSLTVEEPPFSILRTRVSGLYGLPAFDPNNGHEYYEINGRFSLISLVPSNDDYQTPIMNSVTVRQDLERQLGDLREEFNSLSQEIAMTQLIDLALLPLDMFSMFSGIKSTIDAAKSMATKVMKKFKKSGLATSISELTGSLSNAASSVSRNSSIRSNISSISVWTDVSEQIAGTSDSVRNISTQTSAISKKLRLREITTQTEGMNFDDISAAVLKTKIDKSTHISPDTLPDIITESSEKFIPKRAYRVLKDDEVMEADVDGKFFAYKVDTFEEVPFDVDKFVDLVTDSPVISAIIDFKTLKNLNDNYGITRSQALDLIRSDPRVLRDFINQNNPIIKNRIEQLILQCRL

SEQ ID NO: 6 - protein, 775 aa, Artificial Sequence
  Rotavirus VP4
MASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSRSIQYKRAQVNEDITISKTSLWKEMQYNRDIIIRFKFGNSIVKLGGLGYKWSEISYKAANYQYNYLRDGEQVTAHTTCSVNGVNNFSYNGGSLPTDFSVSRYEVIKENSYVYVDYWDDSKAFRNMVYVRSLAANLNSVKCTGGSYDFSIPVGAWPVMNGGAVSLHFAGVTLSTQFTDFVSLNSLRFRFSLTVDEPSFSILRTRTVNLYGLPAANPNNGNEYYEISGRFSLISLVPTNDDYQTPIMNSVTVRQDLERQLTDLREEFNSLSQEIAMSQLIDLALLPLDMFSMFSGIKSTIDLTKSMATSVMKKFRKSKLATSVSEMTNSLSDAASSASRSVSVRSNISAVSNWTNVSNDVSNVTNSVNDISTQTSTISKNLRLKEMITQTEGMSFDDISAAVLKTKIDMSTQIGKNTLPDIVTEASEKFIPKRSYRILKDDEVMEINTEGKFFAYKIDTLNEVPFDVNKFTELVTNSPVISAIIDFKTLKNLNDNYGITRTEALNLIKSNPNVLRNFINQNNPIIRNRIEQLILQCKL

SEQ ID NO: 7 - protein, 775 aa, Artificial Sequence
  Rotavirus VP4
  misc_feature (368)..(368): Xaa can be any naturally occurring amino acid
MASLIYRQLLTNSYSVDLHDEIEQIGSEKTQNVTINPGPFAQTRYAPVNWDHGEINDSTTVEPILDGPYQPTTFTPPNDYWILINSNTNGVVYESTNNSDFWTAVVAIEPHVNPVDRQYMIFGESKQFNVSNDSNKWKFLEMFRSSSQNEFYNRRTLTSDTRLVGIFKYGGRVWTFHGETPRATTDSSSTANLNNISITIHSEFYIIPRSQESKCNEYINNGLPPIQNTRNVVPLPLSSRSIQYKRAQVNEDIIVSKTSLWKEMQYNRDIIIRFKFGNSIVKMGGLGYKWSEISYKAANYQYNYLRDGEQVTAHTTCSVNGVNNFSYNGGFLPTDFGISRYEVIKENSYVYVDYWDDSKAFRNMVYVXSLAANLNSVKCTGGSYYFSIPVGAWPVMNGGAVSLHFAGVTLSTQFTDFVSLNSLRFRFSLTVDEPPFSILRTRTVNLYGLPAANPNNGNEYYEISGRFSLISLVPTNDDYQTPIMNSVTVRQDLERQLTDLREEFNSLSQEIAMAQLIDLALLPLDMFSMFSGIKSTIDLTKSMATSVMKKFRKSKLATSISEMTNSLSDAASSASRNVSIRSNLSAISNWTNVSNDVSNVTNSLNDISTQTSTISKKLRLKEMITQTEGMSFDDISAAVLKTKIDMSTQIGKNTLPDIVTEASEKFIPKRSYRILKDDEVMEINTEGKFFAYKINTFDEVPFDVNKFAELVTDSPVISAIIDFKTLKNLNDNYGITRTEALNLIKSNPNMLRNFINQNNPIIRNRIEQLILQCKL

SEQ ID NO: 8 - protein, 776 aa, Artificial Sequence
  Rotavirus VP4
MASLIYRQLLANSYAVDLSDEIQSVGSEKNQRVTVNPGPFAQTVYAPVNWGPGEVNDSTVVQPVLDGPYQPASFDLPVGNWMLLAPTGPGVVVEGTDNSGRWLSVILIEPGVTSETRTYTMFGSSKQVLVSNASDTKWKFVEMMKTAIDGDYAEWGTLLSDTKLYGMMKYRKRLFIYEGETPNATTKRYIVTNYASVEVRPYSDFYIISRSQESACTEYINNGLPPIQNTRNVVPVAISSRSIEPRKVQANEDIVVSKTSLWKEMQYNRDIIIRFRFDNSIIKSGGLGYKWAEISFKAANYQYNYMRDGEEVTAHTTCSVNGVNDFSFNGGSLPTDFAISRYEVIKENSYVYVDYWDDSQAFRNVVYVRSLAANLNDVMCSGGDYSFALPVGQWPVMKGGAVTLHTAGVTLSTQFTDYVSLNSLRFRFRLAVEEPSFTITRTRVSKLYGLPAANPNGGREYYEVAGRFSLISLVPSNDDYQTPIMNSVTVRQDLERRLNELREEFNNLSQEIAVSQLIDLAMLPLDMFSMFSGIEGTVNAAKSMATNVMRKFKSSKLASSVSMLTDSLSDAASSIARSTSIRSIGSTASAWANISEQTQDAVNEVATISSQVSQISGKLRLKEITTQTEGMNFDDISAAVLKAKIDRSIQVDQNALPDVITEASEKFIRNRAYRVIDGDEAFEAGTDGRFFAYKVETLEEMPFNIEKFADLVTNSPVISAIIDFKTLKNLNDNYGITREQAFNLLRSNPKVLRGFIDQNNPIIKNRIEQLIMQCRL

SEQ ID NO: 9 - protein, 776 aa, Artificial Sequence
  Rotavirus VP4
MASLIYRQLLANSYAVDLSDEIQSVGSEKNQRVTVNPGPFAQTVYAPVNWGPGEVNDSTVVQPVLDGPYQPASFDLPVGNWMLLAPTGPGVVVEGTDNSGRWLSVILIEPGVTSETRTYTMFGSSKQVLVSNASDTKWKFVEMMKTAIDGDYAEWGTLLSDTKLYGMMKYGKRLFIYEGETPNATTKRYIVTNYASVEVRPYSDFYIISRSQESACTEYINNGLPPIQNTRNVVPVAISSRSIEPRKVQANEDIVVSKTSLWKEMQYNRDIIIRFRFDNSIIKSGGLGYKWAEISFKAANYQYNYMRDGEEVTAHTTCSVNGVNDFSFNGGSLPTDFAISRYEVIKENSYVYVDYWDDSQAFRNVVYVRSLAANLNDVMCSGGDYSFALPVGQWPVMKGGAVTLHTAGVTLSTQFTDYVSLNSLRFRFRLAVEEPSFTITRTRVSKLYGLPAANPNGGREYYEVAGRFSLISLVPSNDDYQTPIMNSVTVRQDLERRLNELREEFNNLSQEIAVSQLIDLAMLPLDMFSMFSGIEGTVNAAKSMATNVMRKFKSSKLASSVSMLTDSLSDAASSIARSTSIRSIGSTASAWANISEQTQDAVNEVATISSQVSQISGKLRLKEITTQTEGMNFDDISAAVLKAKIDRSIQVDQNALPDVITEASEKFIRNRAYRVIDGDEAFEAGTDGRFFAYKVETLEEMPFNIEKFADLVTNSPVISAIIDFKTLKNLNDNYGITREQAFNLLRSNPKVLRGFIDQNNPIIKNRIEQLIMQCRL

SEQ ID NO: 10 - protein, 776 aa, Artificial Sequence
  Rotavirus VP4
MASLIYRQLLANSYAVDLSDEIQSVGSEKNQRVTVNPGPFAQTVYAPVNWGPGEVNDSTVVQPVLDGPYQPASFDLPVGNWMLLAPTGPGVVVEGTDNSGRWLSVILIEPGVTSETRTYTMFGSSKQVLVSNASDTKWKFVEMMKTAIDGDYAEWGTLLSDTKLYGMMKYGKRLFIYEGETPNATTKRYIVTKYASVEVRPYSDFYIISRSQESACTEYINNGLPPIQNTRNVVPVAISSRSIEPRKVQANEDIVVSKTSLWKEMQYNRDIIIRFRFDNSIIKSGGLGYKWAEISFKAANYQYNYMRDGEEVTAHTTCSVNGVNDFSFNGGSLPTDFAISRYEVIKENSYVYVDYWDDSQAFRNVVYVRSLAANLNDVMCSGGDYSFALPVGQWPVMKGGAVTLHTAGVTLSTQFTDYVSLNSLRFRFRLAVEEPSFTITRTRVSKLYGLPAANPNGGREYYEVAGRFSLISLVPSNDDYQTPIMNSVTVRQDLERRLNELREEFNNLSQEIAVSQLIDLAMLPLDMFSMFSGIEGTVNAAKSMATNVMRKFKSSKLASSVSMLTDSLSDAASSIARSTSIRSIGSTASAWANISEQTQDAVNEVATISSQVSQISGKLRLKEITTQTEGMNFDDISAAVLKAKIDRSIQVDQNALPDVITEASEKFIRNRAYRVIDGDEAFEAGTDGRFFAYKVETLEEMPFNIEKFADLVTNSPVISAIIDFKTLKNLNDNYGITREQAFNLLRSNPKVLRGFIDQNNPIIKNRIEQLIMQCRL

SEQ ID NO: 11 - protein, 776 aa, Artificial Sequence
  Rotavirus VP4
MASLIYRQLLANSYAVDLSDEIQSVGSEKNQRVTVNPGPFAQTVYAPVNWGPGEVNDSTVVQPVLDGPYQPASFDLPVGNWMLLAPTGPGVVVEGTDNSGRWLSVILIEPGVTSETRTYTMFGSSKQVLVSNASDTKWKFVEMMKTAIDGDYAEWGTLLSDTKLYGMMKYGKRLFIYEGETPNATTKRYIVTKYASVEVRPYSDFYIISRSQESACTEYINNGLPPIQNTRNVVPVAISSRSIEPRKVQANEDIVVSKTSLWKEMQYNRDIIIRFRFDNSIIKSGGLGYKWAEISFKAANYQYNYMRDGEEVTAHTTCSVNGVNDFSFNGGSLPTDFAISRYEVIKENSYVYVDYWDDSQAFRNMVYVRSLAANLNDVMCSGGDYSFALPVGQWPVMKGGAVTLHTAGVTLSTQFTDYVSLNSLRFRFRLAVEEPSFTITRTRVSKLYGLPAANPNGGREYYEVAGRFSLISLVPSNDDYQTPIMNSVTVRQDLERRLNELREEFNNLSQEIAVSQLIDLAMLPLDMFSMFSGIEGTVNAAKSMATNVMRKFKSSKLASSVSMLTDSLSDAASSIARSTSIRSIGSTASAWANISEQTQDAVNEVATISSQVSQISGKLRLKEITTQTEGMNFDDVSAAVLKAKIDRSIQVDQNALPDVITEASEKFIRNRAYRVIDGDEAFEAGTDGRFFAYKVETLEEMPFNIEKFADLVTNSPVISAIIDFKTLKNLNDNYGITREQAFNLLRSNPKVLRGFIDQNNPIIKNRIEQLIMQCRL

SEQ ID NO: 12 - protein, 775 aa, Artificial Sequence
  Rotavirus VP4
MASLIYRQLLTNSYSVDLHDEIEQIGSEKTQNVTVNPGPFAQTRYAPVNWGYGEINDSTTVEPILDGPYQPTTFTPPIDYWILINSNTNGVVYESTNNSDFWTAVVAIEPHVNPVDRQYTVFGENKQFNVRNDSDKWKFLEMFRSSSQNEFYNRRTLTSDTKLVGILKYGGRIWTFHGETPRATTDSSNTANLNDISIIIHSEFYIIPRSQESKCNEYINNGLPPIQNTRNVVPLSLSSRSIQYKRAQVNEEITISKTSLWKEMQYNSDIIIRFKFGNSIVKLGGLGYKWSEISFKAANYQYNYLRDGEQVTAHTTCSVNGVNNFSYNGGSLPTDFSISRYEVIKENSYVYVDYWDDSKAFRNMVYVRSLAANLNSVKCAGGRYHFSLPVGAWPVMNGGAVSLHFAGVTLSTQFTDFVSLNSLRFRFSLTVDEPSFSILRTRTVNLYGLPAANPNNGNEYYEISGRLSLISLVPTNDDYQTPIMNSVTVRQDLERQLTDLREEFNSLSQEIAMSQLIDLALLPLDMFSMFSGIKSTIDLTKSMATSVMKKFRKSKLATSISEMTNSLSDAASSASRSVSIRSNISTISNLTNVSNDVSNVTNSLNDISTQTSTISKKLRLREMITQTEGMSFDDISAAVLKTKIDMSTQIGKNTLPDIVTEASEKFIPKRSYRILKDDEVMEINTEGKVFAYKIDTLNEVPFDVNKFAELVTNSPVISAIIDFKTLKNLNDNYGITRIEALNLIKSNPNVLRNFINQNNPIIRNRIEQLILQCKL

SEQ ID NO: 13 - protein, 775 aa, Artificial Sequence
  Rotavirus VP4
MASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSRSIQYKRAQVNEDIIVSKTSLWKEMQYNRDIIIRFKFGNSIVKMGGLGYKWSEISYKAANYQYNYLRDGEQVTAHTTCSVNGVNNFSYNGGSLPTDFGISRYEVIKENSYVYVDYWDDSKAFRNMVYVRSLAANLNSVKCTGGSYDFSIPVGAWPVMNGGAVSLHFAGVTLSTQFTDFVSLNSLRFRFSLTVDEPPFSILRTRTVNLYGLPAANPNNGNEYYEISGRFSLISLVPTNDDYQTPIMNSVTVRQDLERQLTDLREEFNSLSQEIAMAQLIDLALLPLDMFSMFSGIKSTIDLTKSMATSVMKKFRKSKLATSISEMTNSLSDAASSASRNVSIRSNLSAISNWTNVSNDVSNVTNSLNDISTQTSTISKKLRLKEMITQTEGMSFDDISAAVLKTKIDMSTQIGKNTLPDIVTEASEKFIPKRSYRILKDDEVMEINTEGKFFAYKINTFDEVPFDVNKFAELVTDSPVISAIIDFKTLKNLNDNYGITRTEALNLIKSNPNMLRNFINQNNPIIRNRIEQLILQCKL

SEQ ID NO: 14 - protein, 771 aa, Artificial Sequence
  Rotavirus VP4
IYRQLLTNSYSVDLHDEIEQIGSEKTQNVTINPGPFAQTRYAPVNWDHGEINDSTTVEPILDGPYQPTTFTPPNDYWILINSNTNGVVYESTNNSDFWTAVVAIEPHVNPVDRQYMIFGESKQFNVSNDSNKWKFLEMFRSSSQNEFYNRRTLTSDTRLVGIFKYGGRVWTFHGETPRATTDSSSTANLNNISITIHSEFYIIPRSQESKCNEYINNGLPPIQNTRNVVPLPLSSRSIQYKRAQVNEDIIVSKTSLWKEMQYNRDIIIRFKFGNSIVKMGGLGYKWSEISYKAANYQYNYLRDGEQVTAHTTCSVNGVNNFSYNGGFLPTDFGISRYEVIKENSYVYVDYWDDSKAFRNMVYVKSLAANLNSVKCTGGSYYFSIPVGAWPVMNGGAVSLHFAGVTLSTQFTDFVSLNSLRFRFSLTVDEPPFSILRTRTVNLYGLPAANPNNGNEYYEISGRFSLISLVPTNDDYQTPIMNSVTVRQDLERQLTDLREEFNSLSQEIAMAQLIDLALLPLDMFSMFSGIKSTIDLTKSMATSVMKKFRKSKLATSISEMTNSLSDAASSASRNVSIRSNLSAISNWTNVSNDVSNVTNSLNDISTQTSTISKKLRLKEMITQTEGMSFDDISAAVLKTKIDMSTQIGKNTLPDIVTEASEKFIPKRSYRILKDDEVMEINTEGKFFAYKINTFDEVPFDVNKFAELVTDSPVISAIIDFKTLKNLNDNYGITRTEALNLIKSNPNMLRNFINQNNPIIRNRIEQLILQCKL

SEQ ID NO: 15 - protein, 397 aa, Artificial Sequence
  Rotavirus VP6
MDVLYSLSKTLKDARDKIVEGTLYSNVSDLIQQFNQMIITMNGNEFQTGGIGNLPIRNWNFDFGLLGTTLLNLDANYVETARNTIDYFVDFVDNVCMDEMVRESQRNGIAPQSDSLRKLSGIKFKRINFDNSSEYIENWNLQNRRQRTGFTFHKPNIFPYSASFTLNRSQPAHDNLMGTMWLNAGSEIQVAGFDYSCAINAPANTQQFEHIVQLRRVLTTATITLLPDAERFSFPRVINSADGATTWYFNPVILRPNNVEVEFLLNGQIINTYQARFGTIVARNFDTIRLSFQLMRPPNMTPAVAALFPNAQPFEHHATVGMTLRIESAVCESVLADASETMLANVTSVRQEYAIPVGPVFPPGMNWTDLITNYSPSREDNLQRVFTVASIRSMLVK

SEQ ID NO: 16 - protein, 326 aa, Artificial Sequence
  Rotavirus VP7
MYGIEYTTILTILISIILLNYILKTITNTMDYIIFRFLLLIALMSPFVKTQNYGMYLPITGSLDAVYTNSTSGESFLTSTLCLYYPTEAKNEISDNEWENTLSQLFLTKGWPTGSVYFKDYNDITTFSMNPQLYCDYNVVLMRYDNTSELDASELADLILNEWLCNPMDISLYYYQQNSESNKWISMGTDCTVKVCPLNTQTLGIGCKTTDVDTFEIVASSEKLVITDVVNGVNHKINISINTCTIRNCNKLGPRENVAIIQVGGPNALDITADPTTVPQIQRIMRVNWKKWWQVFYTVVDYINQIIQVMSKRSRSLDTAAFYYRI

SEQ ID NO: 17 - protein, 326 aa, Artificial Sequence
  Rotavirus VP7
MYGIEYTTVLTFLISVILLNYVLKSLTRIMDFIIYRSLLIIVILSPLLNAQNYGIDLPITGSMDTPYTNSTREELFLTSTLCLYYPTEAATEINDNSWKDTLSQLFLTKGWPTGSVYFKDYTDIASFSVDPQLYCDYNLVLMKYDVTLQLDMSELADLLLNEWLCNPMDITLYYYQQTDEANKWISMGSSCTIKVCPLNTQTLGIGCLTTDTNTFEEIATDEKLVITDVVDGVNHKLNVTTNTCTIRNCKKLGPRENVAVIQVGGSNVLDITADPTTTPQTERMMRVNWKKWWQVFYTIVDYVNQIVQAMSKRSRSLNSAAFYYRV

SEQ ID NO: 18 - protein, 326 aa, Artificial Sequence
  Rotavirus VP7
MYGIEYTTILIFLISIILLNYILKSVTRIMDYIIYRFLLIFVALFALTKAQNYGLNIPITGSMDTVYSNSTREEVFLTSTLCLYYPTEASTQISDGEWKDSLSQMFLTKGWPTGSVYFKEYSNIVDFSVDPQLYCDYNLVLMKYDQNLELDMSELADLILNEWLCNPMDITLYYYQQSGESNKWISMGSSCTVKVCPLNTQTLGIGCQTTNTDSFETVAENEKLAIVDVVDGINHKINLTTTTCTIRNCKKLGPRENVAVIQVGGANILDITADPTTNPQIERMMRVNWKRWWQVFYTIVDYINQIVQVMSKRSRSLNSAAFYYRV

SEQ ID NO: 19 - protein, 326 aa, Artificial Sequence
  Rotavirus VP7
MYGIEYTTILIFLISIILLNYILKSVTRIMDYIIYRSLLIYVALFALTRAQNYGLNLPITGSMDTVYANSTQEGIFLTSTLCLYYPTEASTQINDGEWKDSLSQMFLTKGWPTGSVYFKEYSSIVDFSVDPQLYCDYNLVLMKYDQNLELDMSELADLILNEWLCNPMDITLYYYQQSGESNKWISMGSSCTVKVCPLNTQMLGIGCQTTNVDSFEMVAENEKLAIVDVVDGINHKINLTTTTCTIRNCKKLGPRENVAVIQVGGSNVLDITADPTTNPQTERMMRVNWKKWWQVFYTIVDYINQIVQVMSKRSRSLNSAAFYYRV

SEQ ID NO: 20 - protein, 326 aa, Artificial Sequence
  Rotavirus VP7
MYGIEYTTILIFLISIILLNYILKSVTRIMDYIIYRFLLITVALFALTRAQNYGLNLPITGSMDAVYTNSTQEEVFLTSTLCLYYPTEASTQINDGDWKDTLSQMFLTKGWPTGSVYFKEYSSIVDFSVDPQLYCDYNLVFMKYDQSLELDMSELADLILNEWLCNPMDVTLYYYQQSGESNKWISMGSSCTVKVCPLNTQTLGIGCQTTNVDSFEMIAENEKLAIVDVVDGINHKINLTTTTCTIRNCKKLGPRENVAVIQVGGSNVLDITADPTTNPQTERMMRVNWKKWWQVFYTIVDYINQIVQVMSKRSRSLNSASFYYRV

SEQ ID NO: 21 - protein, 326 aa, Artificial Sequence
  Rotavirus VP7
MYGIEYTTILTILISIILLNYILKTITNTMDYIIYRFLLVIVLISPFVRTQNYGIYLPITGSLDAVYTNSTSGETFLTSTLCLYYPAEAKNEISDDEWENTLSQLFLTKGWPTGSVYFKDYNDITTFSMNPQLYCDYNVVLMRYDNTSELDASELADLILNEWLCNPMDISLYYYQQSSESNKWISMGTDCTVKVCPLNTQTLGIGCKTTDVSTFEIVASSEKLVITDVVNGVNHKINISISTCTIRNCNKLGPRENVAIIQVGGPNALDITADPTTVPQIQRIMRINWKKWWQVFYTVVDYINQIVQVMSKRSRSLDAAAFYYRV

SEQ ID NO: 22 - protein, 326 aa, Artificial Sequence
  Rotavirus VP7
MYGIEYTTVLTFLISVILLNYVLKSLTRIMDFIIYRFLLIIVILSPLLNAQNYGINLPITGSMDTSYTNSTREEVFLTSTLCLYYPTEAATEINDNSWKDTLSQLFLTKGWPTESIYFKDYTDIASFSVDPQLYCDYNLVLMKYDATLQLDMSELADLLLNEWLCNPMDITLYYYQQTDEANKWISMGSSCTIKVCPLNTQTLGIGCLTTDANTFEEVATAEKLVITDVVDGVNHKLKVTTDTCTIRNCKKLGPRENVAVIQVGGSDVLDITADPTTAPQTERMMRVNWKKWWQVFYTIVDYVNQIVQAMSKRSRSLNSAAFYYRV

SEQ ID NO: 23 - protein, 326 aa, Artificial Sequence
  Rotavirus VP7
MYGIEYTTVLFYLISFVLVSYILKTMIKIMDYLIYRITFVIVVLSVLSNAQNYGINLPITGSMDTAYANSTQDNNFLSSTLCLYYPSEAPTQISDTEWKDTLSQLFLTKGWPTGSVYFNEYSNVLEFSIDPKLYCDYNVVLIRFASGEELDVSELADLILNEWLCNPMDITLYYYQQTGEANKWISMGSSCTVKVCPLNTQTLGIGCQTTDTATFETVADSEKLALIDVVDNVNHKLDVTSTTCTIRNCNKLGPRENVAIIQVGGSNILDITADPTTSPQTERMMRVNWKKWWQVFYTVVDYINQIVKVMSKRSRSLDSSSFYYRV

SEQ ID NO: 24 - protein, 326 aa, Artificial Sequence
  Rotavirus VP7
MYGIEYTTILIFLTSITLLNYILKSITRIMDYIIYRFLFMVVILATIINAQNYGVNLPITGSMDTAYANSTQSEPFLTSTLCLYYPVEASNEIADTEWKDTLSQLFLTKGWPTGSVYFKEYADIAAFSVEPQLYCDYNLVLMKYDSTQKLDMSELADLILNEWLCNPMDITLYYYQQTDEANKWISMGSSCTVKVCPLNTQTLGIGCLITNPDTFETVATTEKLVITDVVDGVNHKLNVTTATCTIRNCKKLGPRENVAVIQVGGANILDITADPTTTPQTERMMRINWKKWWQVFYTVVDYVNQIIQTMSKRSRSLNSSAFYYRV

SEQ ID NO: 25 - protein, 326 aa, Artificial Sequence
  Rotavirus VP7
MYGIEYTTILIFLISIILLNYILKSVTRIMDYIIYRFLLITVALFALTRAQNYGLNLPITGSMDAVYTNSTQEEVFLTSTLCLYYPTEASTQINDGDWKDSLSQMFLTKGWPTGSVYFKEYSNIVDFSVDPQLYCDYNLVLMKYDQSLELDMSELADLILNEWLCNPMDVTLYYYQQSGESNKWISMGSSCTVKVCPLNTQTLGIGCQTTNVDSFEMIAENEKLAIVDVVDGINHKINLTTTTCTIRNCKKLGPRENVAVIQVGGSNVLDITADPTTNPQTERMMRVNWKKWWQVFYTIVDYINQIVQVMSKRSRSLNSAAFYYRV

SEQ ID NO: 26 - protein, 326 aa, Artificial Sequence; identical to SEQ ID NO: 19
  Rotavirus VP7

SEQ ID NO: 27 - protein, 493 aa, Artificial Sequence
  Rotavirus NSP1
MKSLVEAMATFKDACYQYKKLNKLNNAVLKLGANDVWRPSTLTKRKGWCLDCCQHTDLTYCQGCLIYHVCEWCSQYSRCFLDNDPHLLRMRTFRNEITKSDLENLINMYDTLFPINQKIVNKFANTIKQHKCRNEYLIQWYNHFLMPVTLQSLSIELDGDIYYIFGYYDDMHKINQTPFSFTNLISKYDVLLLDSINFDRMAFLPLTLQQEYALRYFSKSRFITERRKCIEISHFSDNILNDLHNPNFTLQVIRNCSNMSVEWNKACNLIKNISNYFNILKSSHTESYNVSPRCRVFTQYKLKIASKLIKPNYVASNHNSLATEVHNCKWCSINNNSIVWTDFRIKNVYNDIFNFIRALVKSNLYVGHCSSEEKIYESIKDILNVCEENEWNMLVTEIFNQLDPIKLNEDSYVLLNYEINWNVMNVLINSIGKVPKILTLSDVISILRIIIYDWFDIRFMRNTPMTTFTVNKLKQLYEKDRTAEYDSGISDVE

SEQ ID NO: 28 - protein, 317 aa, Artificial Sequence
  Rotavirus NSP2
MAELACFCYPHLENDSYKFIPFNNLAIKCMLTAKVEKKDQDKFYNSIVYGIAPPPQFKKRYNTNDNSRGMNYETAMFNKVAVLICEALNSIKVTQSDVAIVLSRVVSVRHLENLVLRRENHQDVLFHSKELLLKSVLIAIGHSKEIETTATAEGGEIVFQNVAFTMWKLTYLEHKLMPILDPNFIEYKITVNEDKPISESHVKELIAELRWQYNKFAVITHGKGHYRVVKYSSVANHADRVYATFKSNNKNGGPLEFNLLDQRIIWQNWYAFTSSMKQGNTLDICKKLLFQKMKRESNPFKGLSTDRKMDEVSQVGI

SEQ ID NO: 29 - protein, 313 aa, Artificial Sequence
  Rotavirus NSP3
MLKMESTQQMASSIINSSFEAAVVAATSTLELMGIQYDYNEVYTRVKSKFDFVMDDSGVKNNLMGKAVTIDQALNGKFNSSIRNRNWMTDSKTVARLDEDVNKLRLLLSSKGIDQKMRVLNACFSVKRVPGKSSSIIKCTRLMKEKIERGEVEVDDAFIEEKMEIDTIDWKSRYDQLERRFESLKQRVNEKYNNWVIKARKVNENMSSLQNVISQQQAHINELQMYNNKLERDLQSKIGSVISSIEWYLRSMELSDDIKSDIEQQLNSIDHINPVNAFDDFESILRNLISDYDRIFIMFKGLLQQSNYTYTYE

SEQ ID NO: 30 - protein, 175 aa, Artificial Sequence
  Rotavirus NSP4
MEKFTDLNYTLSVITLMNSTLHTILEDPGMAYFPYIASVLTVLFTLHKASIPTMKIALKTSKCSYKVVKYCIVTILNTLLKLAGYKEQITTKDEIEKQMDRVVKEMRRQLEMIDKLTTREIEQVELLKRIYDKLIVRSTDEIDMTKEINQKNVRTLKEWESGKNPYEPKEVTASM

SEQ ID NO: 31 - protein, 175 aa, Artificial Sequence
  Rotavirus NSP4
MEKLTDLNYTLSVITLMNSTLHTILEDPGMAYFPYIASVLTVLFTLHKASIPTMKIALKTSKCSYKVVKYCIVTIFNALLKLAGYKEQITTKDEIEKQMDRVVKEMRRQLEMIDKLTTREIEQVELLKRIHDKLMIRAVDEIDMTKEINQKNVKTLEEWENGKNPYEPKEVTAAM

SEQ ID NO: 32 - protein, 175 aa, Artificial Sequence; identical to SEQ ID NO: 31
  Rotavirus NSP4

SEQ ID NO: 33 - protein, 175 aa, Artificial Sequence; identical to SEQ ID NO: 31
  Rotavirus NSP4

SEQ ID NO: 34 - protein, 175 aa, Artificial Sequence; identical to SEQ ID NO: 31
  Rotavirus NSP4

SEQ ID NO: 35 - protein, 175 aa, Artificial Sequence; identical to SEQ ID NO: 31
  Rotavirus NSP4

SEQ ID NO: 36 - protein, 175 aa, Artificial Sequence
  Rotavirus NSP4
MDKLADLNYTLSVITLMNDTLHSIIQDPGMAYFPYIASVLTVLFTLHKASIPTMKIALKTSKCSYKVIKYCIVTIINTLLKLAGYKEQVTTKDEIEQQMDRIVKEMRRQLEMIDKLTTREIEQVELLKRIHDNLITRPVDVIDMSKEFNQKNIKTLDEWESGKNPYEPSEVTASM

SEQ ID NO: 37 - protein, 175 aa, Artificial Sequence
  Rotavirus NSP4
MDKLADLNYTLSVITLMNDTLHSIIQDPGMAYFSYIASVLTVLFILHKASIPTMKIALKTSKCSYKVIKYCIVTIINTLLKLAGYKEQVTTKDEIEQQMDRIVKEMRRQLDMIDKLTTREIEQVELLKRIHDNLITRPVDVIDMSKEFNQKNIKTLDEWESGKNPYEPSEVTASM

SEQ ID NO: 38 - protein, 200 aa, Artificial Sequence
  Rotavirus NSP5
MSLSIDVTSLPSISSSVYKNESFSTTSTISGKSIGRSEQYISPDAEAFSKYMLSKSPEDIGPSDSASNDPLTSFSIRSNAVKTNADAGVSMDSSAQSRPSSDIGYDQMDFSLNKGIKIDATMDSSISISTTSKKDKSKQENKNKYKKCYPKIEAESDSDEYILDDSDSDDGKCKNCKYKKKYFALRLRMKQVAMQLIKDL

SEQ ID NO: 39 - protein, 92 aa, Artificial Sequence
  Rotavirus NSP6
MNRLLQRQLFLENLLVGVNSTFHQMQKHSINTCCRSLQRILDHLILLQTIHSPAFQLDRMQLRQMQTLACLWIHRRNHDLQVTLDAINWISP

SEQ ID NO: 40 - protein, 529 aa, Artificial Sequence
  Rotavirus VP5*
AQVNEDIIVSKTSLWKEMQYNRDIIIRFKFGNSIVKMGGLGYKWSEISYKAANYQYNYLRDGEQVTAHTTCSVNGVNNFSYNGGSLPTDFGISRYEVIKENSYVYVDYWDDSKAFRNMVYVRSLAANLNSVKCTGGSYNFSIPVGAWPVMNGGAVSLHFAGVTLSTQFTDFVSLNSLRFRFSLTVDEPPFSILRTRTVNLYGLPAANPNNGNEYYEISGRFSLIYLVPTNDDYQTPIMNSVTVRQDLERQLTDLREEFNSLSQEIAMAQLIDLALLPLDMFSMFSGIKSTIDLTKSMATSVMKKFRKSKLATSISEMTNSLSDAASSASRNVSIRSNLSAISNWTNVSNDVSNVTNSLNDISTQTSTISKKFRLKEMITQTEGMSFDDISAAVLKTKIDMSTQIGKNTLPDIVTEASEKFIPKRSYRILKDDEVMEINTEGKFFAYKINTFDEVPFDVNKFAELVTDSPVISAIIDFKTLKNLNDNYGITRTEALNLIKSNPNMLRNFINQNNPIIRNRIEQLILQCKL

SEQ ID NO: 41 - protein, 240 aa, Artificial Sequence
  Rotavirus VP8* P[8]
MASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 42 - protein, 776 aa, Artificial Sequence
  Rotavirus VP4 P[1] (inlcudes VP8* P[1])
MASFIYRQLLTNSYTVDLSDEIQEIGSTKTQNVTINPGPFAQTNYAPVNWGPGETNDSTTVEPVLDGPYQPTTFNPPVSYWMLLAPTNAGVVVEGTNNTNRWLATILIEPDVQSVERTYTLFGQQVQLTVSNDSQTKWKFIDVSKQTQDGNYSQHGPLLSTPKLYGVMKHGGKIYTYNGETPNANTGYYSTTNFDTVNMTAFCDFYIIPLAQEAKCTEYINNGLPPIQNTRNVVPVSIASRSIVHTKAQANEDIVVSKTSLWKEMQYNRDIIIRFKFANSIVKSGGLGYKWSEVSFKPANYQYTYTRDGEEVTAHTTCSVNGVNDFNYNGGSLPTDFVISKYEVIKENSYVYIDYWDDSQAFRNMVYVRSLAANLNTVMCTGGDYSFALPVGNYPVMTGGAVSLHSAGVTLSTQFTDFVSLNSLRFRFRLAVEEPPFAIMRTRVSGLYGLPAAKPNNSQEYYEIAGRFSLISLVPSNDDYQTPIMNSVTVRQDLERQLGELRDEFNNLSQQIAMSQLIDLALLPLDMFSMFSGIKSTIDAAKSMATNVMKRFKKSGLANSVSTLTDSLSDAASSVSRSASIRSIGSTTSAWTEVSTTTSGISGLTNSISTQTSTISKRLRLKEMATKTDGMNFDDISAAVLKTKIDRSTQVTPNTLPEIVTEASEKFIPNRAYRVIDNDEVLEASTDGKFFAYRVETFEEVPFDVQKFADLVTDSPVISAIIDFKTLKNLNDNYGISKQQALNLLRSDPKVLREFINQNNPIIRNRIESLIMQCRL

SEQ ID NO: 43 - protein, 776 aa, Artificial Sequence
  Rotavirus VP4 P[2] (inlcudes VP8* P[2])
MASLIYRQLLANSYAVDLSDEIQSVGSEKNQRVTVNPGPFAQTGYAPVNWGPGEVNDSTVVQPVLDGPYQPAAFDLPVGNWMLLAPTGPGVVVEGTDNSGRWLSVILIEPDVTSETRTYTMFGSSRQVLVSNASATKWKFVEMMKTAVDGDYAEWGTLLSDTKLYGMMKYGERLFIYEGETPNATTKGYIVTNYASVEVRPYSDFYIISRSQESACTEYINNGLPPIQNTRNVVPVAISSRSIEPRKVQANEDIIVSKTSLWKEMQYNRDIIIRFRFDNSIIKSGGLGYKWAEISFKAANYQYNYTRDGEEVTAHTTCSVNGVNDFSFNGGSLPTDFAISRYEVIKENSYVYVDYWDDSQAFRNMVYVRSLAANLNDVMCSGGDYSFALPAGQWPVMKGGAVALHTAGVTLSTQFTDYVSLNSLRFRFRLTVEEPSFTITRTRVSKLYGLPAANPNGGREYYEVAGRFSLISLVPSNDDYQTPIMNSVTVRQDLERRLNELREEFNNLSQEIAVSQLIDLAMLPLDMFSMFSGIEGTVNAAKSMATNVMRKFKNSKLASSVSMLTDSLSDAASSVARSTSIRSIGSTASAWANISEQTQDAANEVATISSQVSQISGKLRLKEITTQTEGMNFDDISAAVLKAKIDRSIQVDQNALPDVITEASEKFIRNRAYRVIDGDEVFEAGTDGRFFAYKVETLEEMPFNIEKFADLVTNSPVISAIIDFKTLKNLNDNYGISREQAFNLLRSNPKVLRGFIDQNNPIIKNRIEQLIMQCRL

SEQ ID NO: 44 - protein, 768 aa, Artificial Sequence
  Rotavirus VP4 P[3] (inlcudes VP8* P[3])
MASPFYRQLLTNSYTVDSSDEIQEIGSTKTQNTTINPGPFAQTGYAPVNWGPGETNDSTTVEPVLDGPYQPTTFNPPVDYWMLLAPATAGVVVEGTNNTDRWLATILVEPNVASVTRNYTIFGIQEQIVVANTSQTQWKSIDVVKTTQNGTYSQYGPLLSTPKLCAVMKHNGKIYTYNGETPNATTGYYSTTNYDSVNMTAFCDFYIIPRSEEATCTEYINNGLPPVQNTRNVVPLALSARNIISPRAQANEDIVVSKTSLWKEMQYNRDITIRFKFANSIIKSGGLGYKWSEISFKPANYRYTYMRDGEEVTAHTTCSVNGMSDFNFNGGSLPTDFVISRYEVIKENSYVYVDYWDDSQAFRNMVYVRSLAANLNSVMCTGGDYSFALPVGQWPVMTGGAVSLHSAGVTLSTQFTDFVSLNSLRFRFRLAVEEPSFAITRTRVSRLYGLPAANPKNGKEYYEVAGRFSLISLVPSNDDYQAPIANSVAVRKDLERQLGELREEFNALSQEIAMSQLIDLALLPLDMFSMFSGIKSTIDAAKSMATNVMKKFKRSGLAGSVSTLTDSLSDAASSISRGASIRSVGSSVSAWTDVSTQVTDISSSVSTISTQTSTISRRLRLKEMATQTEGMNFDDISAAVLKTKIDRSTQISPNTLPDIVTEASEKFIPNRAYRVINNDEVFEAGTDGRFFAYRVETFEEIPFDVQKFADLVTDSPVISAIIDFKTLKNLNGNYGISKQQAFNLLRSDPRVFREFINQDNPIIRNRIE

SEQ ID NO: 45 - protein, 240 aa, Artificial Sequence
  Rotavirus VP8* P[4]
MASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 46 - protein, 776 aa, Artificial Sequence
  Rotavirus VP4 P[5] (inlcudes VP8* P[5])
MASLIYRQLLANSYAVDLSDEIQSVGSEKNQRVTVNPGPFAQTVYAPVNWGPGEVNDSTVVQPVLDGPYQPASFDLPVGNWMLLAPTGPGVVVEGTDNSGRWLSVILIEPGVTSETRTYTMFGSSKQVLVSNASDTKWKFVEMMKTAIDGDYAEWGTLLSDTKLYGMMKYGKRLFIYEGETPNATTKRYIVTNYASVEVRPYSDFYIISRSQESACTEYINNGLPPIQNTRNVVPVAIVSRSIKPREVQANEDIVVSKTSLWKEMQYNRDIIIRFKFDNSIIKSGGLGYKWAEISFKAANYQYNYMRDGEDVTAHTTCSVNGVNDFSFNGGSLPTDFAISRYEVIKENSYVYVDYWDDSQAFRNMVYVRSLAANLNDVMCSGGHYSFALPAGQWPVMKGGAVTLHTAGVTLSTQFTDYVSLNSLRFRFRLAAEEPSFTITRTRVSKLYGIPAANPNGGREYYEVAGRFSLISLVPSNDDYQTPIMNSVTVRQYLERHLNELREEFNNLSQEIAVSQLIDLAMLPLDMFSMFSGIESTVNAAKSMATNVMRKFKSSKLASSVSMLRDSLSDGASSIARSTSIRSIGSTASAWANISERTQDAVNEVATISSQVSQISGKLRLKEITTQTEGMNFDDVSGAVLKAKIDRSIQVDQNALPDVITEASEKFIRNRAYRVIDGDEAFEAGTDGRFFAYKVETLEEMPFNIEKFADLVTNSPVISAIIDFKTLKNLNDNYGITREQAFNLLRSNPKVLRGFIDQNNPIIKNRIEQLIMQCRL

SEQ ID NO: 47 - protein, 240 aa, Artificial Sequence
  Rotavirus VP8* P[6]
MASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 48 - protein, 776 aa, Artificial Sequence
  Rotavirus VP4 P[7] (inlcudes VP8* P[7])
  misc_feature (721)..(721): Xaa can be any naturally occurring amino acid
MASLIYRQLLTNSYTVNLSDEIQEIGSAKSQDVTINPGPFAQTGYAPVNWGAGETNDSTTVEPLLDGPYQPTTFNPPTSYWVLLAPTVEGVVNQGTNNTDRWLATILIEPNVQTTNRIYNLFGQQVTLSVENTSHTQWLFIDVSKTTLTGNYTQHGPLFSTPKLYAIMRFSGRIYTYNGTTPNATTGYYSTTNYDTVNMTSFCDFYIIPRNQEEKCTEYINHGLPPIQNTRNVVPVSLSAREIVHTRAQVNEDIVVSKTSVWKEMQCNRDITIRFKFDRTIIKAGGLGYKWSEISFKPITYQYTYARDGEQITAHTTCSVNGVNNFSYNGGSLPTDFAISRYEVIKENSFVYIDYWDDSQAFRNMVYVRSLAADLNTVTCTGGSYTFALPVGSYPVMTGGTVSLHPAGVTLSTQFTDFVSLNSLRFRFRLTVGEPPFSITRTRVSRLYGLPAANPNNQREYYEISGRFSLISLVPSNHDYQTPIMNSVTVRQDLERQLGELRDEFNSLSQQIGMSQLIDLALLPLDMFSMFSGIKSTIDAAKSMATNVMKRFKRSNLASSVSTLTDAMSDAASSISRSSSIRSIGSSASAWTEVSTSIVDISTTVDTVSTQTATIAKRLRLKEIATQTDGMNFDDIYAAVLKTKMNKSVQITPNTIPEIVTEASEKFIPNRTYRVINNDEVFEAGMDGKFFAYRVDTFDEIPFNVQKLADLVTDSPVISAXIDLKTLKNLKDNYGISKQQAFDLLRSDPRVLREFINQDNPIIRNRIENLIMQCRL

SEQ ID NO: 49 - protein, 240 aa, Artificial Sequence
  Rotavirus VP8* P[8]
MASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 50 - protein, 775 aa, Artificial Sequence
  Rotavirus VP4 P[9] (inlcudes VP8* P[9])
MASLIYRQLLSNSYVTNISDEVSEIGAKKTTNVTVNPGPFAQTGYAPVDWGHGELPDSTLVQPTLDGPYQPTSFNLPVDYWMLIAPTREGKIAEGTNTTDRWFACVLVEPNVQSTQRQYVLDGQNVQLQVSNDSNTSWKFILFIKLTHDGTYTQYSTLSTPHKLCAWMKRDNRVYWYQGTTPNASESYYLTINNDNSNVSSDAEFYLIPQSQTAMCTQYINNGLPPIQNTRNIVPVNITSRQIKNVRAQMNEDIVISKTSLWKEMQYNRDITIRFKFANSIIKSGGLGYKWSEISFKPMNYQYTYTRDGEEITAHTTCSVNGVNDFNYNGGTLPTDFVISRFEVIKENSYVYIDYWDDSQAFRNMVYVRSLAANLNDVVCSGGSYSFALPVGNHPVMSGGAVTLTSAGVTLSTQYTDYVSLNSLRFRFRLAVSEPSFYISRTRMSGIYGLPAVNPNNNAEYYEIAGRFSLISLVPTNDDYQTPIANSVTVRQDLERQLGELREEFNSLSQEIAVSQLIDLATLPLDMFSMFSGIKSTVETVKSMTTNVMKRFKTSSLANAISDLTNSMSEAASSIRLMSVRSVGTITLPRARVSLQAGDSLRSIQDVSTQVSNVSRNLRLREFTTQTDALNFDDISAAVLKTKLDKSTQISQQTMPDIIAESSEKFIPKRSYRIIDEDTAFETGIDGTFYAYKVDTFDEIPFDIERFNKLITDSPVLSAIIDFKTLKNLNDNYGITKKQAMELLHSNPRTLKEFINNNNPIIRNRIENLISQCRL

SEQ ID NO: 51 - protein, 776 aa, Artificial Sequence
  Rotavirus VP4 P[10] (inlcudes VP8* P[10])
MASLIYRQLLTNSYTVDLSDEIESIGSKNTQNVTINPGPFAQTGYAPVNWGPGEVNDSTTVEPTLDGPYRPTSFNPPVNYWMLLAPLNAGVIVEGTNNTNRWLATILVEPGVASTTRTYTLFGIQEQITVENSSNTKWKFIDLMKTTSSGTYTQHSPLLSEPKLYGIMKHGGQLWTYNGETPNAITNGYPTTNYDSVNMTSFCNFYIIPRSQESVCTGYINNGLPPIQNTRNIVPVSISSRSIIHQRAQANEDIIVSKTSLWKEMKYNRDITIRFKFANAIIKSGGLGYKWSEISFKPANYQYTYTRDGEEVTAHTTCSVNGVNDFSFNGGSLPTDFVISRYEVIKENSYVYVDYWDDSQAFRNMVYVRSLAADLNDVLCTGGDYSFALPVGQWPVMTGGAVSLHSAGVTLSTQFTDFASLNSLRFRFRLSVEEPHFSITRTRVTGLYGLPAANPNNNNEYYEVAGRFSLISLVPSNDDYQTPIANSVTVRQDLERQLGELREEFNALSQEIAMSQLIDLALLPLDMFSMFSGIKSTIDAAKSMATNVMKKFKKSGLATSVSTLTDSLSDAASSISRGSSIRSIGSSASAWTDVSTQLIDVSSTVNTISTQTSTISRRLRLKEIATQTEGMNFDDISAAVLKTKIDRSTQIAPATLPDIVTEASEKFIPNRAYRVMDNNEVLEASTDGRFFAYRVETFEEIPFDVQKFADLVTDSPVISAIIDFKTLKNLNDNYGISREQAFNLLRSDPRMLREFINQDNPIIRNRIEQLILQCRL

SEQ ID NO: 52 - protein, 772 aa, Artificial Sequence
  Rotavirus VP4 P[11] (inlcudes VP8* P[11])
MASLIYRQLLYNSYSVDLSDEITNIGAEKKENVTVQLGEFAQSQYAPVSWGSGETLSGSVEEQTLDGPYTPDSSNLPPSYWYLVNPSNDGVVFSVTDNSTFWMFTYLVLPNTAQTNVTVDVMGETVNISIDNSGSTYRFVDYIKTSSTQAYGSRNYLNTAHRLQAYKRDGDGNISNYWGADTQGDLRVGTYSNPVPNAVINLNADFYVIPGSQQEICTEYIREGLPAMQTTTYVTPISYAVRSQRIARPNEDIIISKASLWKEVQYNRDIVIRFVFANNIIKAGGLGYKWSEISYKANNYQYTYMRDGVEVVAHTTVSVNGVSVYNYNTGPLPTDFMIRNYDVLKENSFVYVDYWDDSQAFRNMVYVRSLNAELNQVRCAGGHYSFALPVGSWPVMQGGSVILTFDGVTLSTQFTDYVSLNSLRFRFRCAVSEPPFRVTGTRISNLYGLPAANPMGDQQYYEASGRFSLISLVPSNDDYQTPIANSVTVRQDLERQLDEMRKEFNELSANIALSQLIDLALLPLDMFSMFSGIQSTVEAAKSFATSVMKKFRKSDLAKSVNSLTDAITDAAGSISRSSTLRSVNSAASVWTDISDVVDSTDNVVAATATAAAKKFRVKEFTTEFNGVSFDDISAAVVKTKMNKLNVVDEEILPQIITEASEKFIPNRAYRLIDGDKAYEVTTEGKYFAYLTETFEEVVFDAERFAELVTDSPVISAIIDFKTIKNLNDNYGITREQALNMLRSDPKVLRSFINQNNPIIKNRIEQLILQCRI

SEQ ID NO: 53 - protein, 776 aa, Artificial Sequence
  Rotavirus VP4 P[12] (inlcudes VP8* P[12])
MASLIYRQLLANSYTVDLSDEIENIGYRKSKNVTINPGPFAQTGYTPVNWGPGEVNDSTTVEPILDGPYQPTNFNPPVNYWMLLSPLNAGVVEEGTNSINRWLATVLVEPNVVTTVRTYTLFGVQEQISVENNSTTKWKFMNLIKTTLSGNFTLYSTLLSEPKLHGIMKHGGQLWVYNGETQTLLLQDYVTSNYDSLTMTSFCDFYIIPRSQESTCTEYINNGLPPIQNTRNVVSVSISSRNIIHNRAQVNEDIVISKTSLWKGVQYNRDITIRFRFANAIIKSGGLGYKWSEISFKPANYQYTYTRDGEEITAHTTCSVNGVNDFSFNGGSLPTDFVISRYEVIKENSYVYVDYWDDSQAFRNMVYVRSLAANLNDVLCIGGDYSFALPVGQWPVMTGGAVMLHAAGVTLSTQFTDFVSLNSLRFRFSLSVEEPYFSITRTRVTRLYGLPAVNPNNNRDYYEIAGRFSLISLVPSNDDYQTPIMNSVTVRQDLERQLGELREEFNTLSQEIAVSQLIDLALLPLDMFSMFSGIKSTIDAAKSMATNVMKKFKKSKLASSVSTLTNLLSDAASSVSRNSSIRSVSSSVSAWTDVSNQLTDISNSVNSISTQTSTISRRLRLKEIATQTEGMNFDDISAAVLKTKIDKSTQIAANNIPDIITEASKKFIPNRAYRVISNDYVFEASTDGRFFAYKVGTFEEIPFDVQKFADLVTDSPVISAIIDFKTLKNLNDNYGITREQAFNLLRSDPRVLREFINQDNPIIKNRIEQLILQCRL

SEQ ID NO: 54 - protein, 778 aa, Artificial Sequence
  Rotavirus VP4 P[13] (inlcudes VP8* P[13])
MASLIYRQLLTNSYTTDLSDEIEEIGSSKSQDVTINPGPFAQTGYAPVDWGLGETNDSTTVAPVLDGPYQPITFTPPIEYWALFAPNDKGVVAELTNNADMWLVIILVEPNVPQELRLYTLFGQQVNLTIENTSQTKWKFIDFRKRSQNDTYILENALLSETKLQAAMKYGGKLFTFTGDTPNAAPQEWGYTTNNYSAISIKSLCDFYIVPRLPRETCRNYINQGLPPMQNTRNVVSVALSARDVISQRVSINEDIVVSKASLWKEMQYNRDITIRFKFANQIIKSGGLGYKWSEISFKPANYQYTYTRNGEEITAHTTCSVNGVNNFSYNGGSLPTDFVISRYEVIKENSYVYIDYWDDSQAFRNMVYVRSLAADLNSVTCSGGSYSFALPLGNFPVMSGGAVSLHPSGVTLSTQFTDFVSLNSLRFRFRLAVEEPPFSITRTRVSRLYGLPAVNPNNAKDFYEIAGRFSLISLIPPNDDYQTPIMNSVTVRQDLERQLGELRNEFNALSQQIAMSQLIDLALLPLDMFSMFSGIKGTIDIAKSMATNVMKKFRKSNLANSVSALTESLSDAASSISRRSTIRTIGSSASAWTEVSTAVIDTTTATNSISTQTATITKRLRLKEMAIQTDGMNFDDISAAVLKTKIDKSTQIAPNTLPDIVTEASEKFIPNRAYRVMDNDEVFEAGTDGKFFAYRVETFEEIPFDVQKFADLITDSPVISAIIDFKTLKNLNDNYGITKQQAYNLLRSDPRVLREFINQENPIIRNRIENLIMQCRL

SEQ ID NO: 55 - protein, 776 aa, Artificial Sequence
  Rotavirus VP4 P[14] (inlcudes VP8* P[14])
MASLIYRQLLSNSYVTNISDEVSEIGARKTTNVTVNPGPFAQTGYAPVDWGHGELSDSTLVQPTLDGPYQPTTFNLPINYWMLIAPTQAGRVAEGTNTTNRWFACVLVEPSVQSTRREYVLDGQTVQLQVSNDSSTLWKFILFIKLEKNGTYSQYSTLSTSNKLCAWMKREGRVYWYTGTTPNASESYYLTINNDNSHVSCDAEFYLLPRSQTDLCDQYINNGLPPVQNTRNVVPVSITSREIRYTKAQVNEDIVVSKTSLWKEMQYNRDIMIRFKFANSIVKSGGLGYKWSEISFKPMNYQYTYTRDGEEITAHTTCSVNGVNDFSYNGGTLPTDFSISRFEVIKENSFVYIDYWDDSQAFRNMVYVRSLSANLNDVVCSGGDYSFALPVGAWPVMSGGAVTLSSAGVTLSTQFTDYVSLNSLRFRFRLTVSEPSFSISRTRLSGIYGLPAANPNNNVEYYEIAGRFSLISLVPTNDDYQTPIANSVTVRQDLERQLGELREEFNALSQEIALSQLIDLATLPLDMFSMFSGIKSTVEAVKSMTTNVMKKFKTSNLANAISDLTNSMSDAASSVSRSASVRSISSNAASRISTAIQASDDLRTVADASTQISSVSRSLRLREFTTQTDNLSFDDISAAVLKTKLDKSTQISQSTIPDIISESSEKFIPMRTYRVIDNDTAFETGIDGTFYAYRVDTFDEVPFDVERFNKLITDSPVLSAIIDFKTLKNLNDNYGITKTQAMELLQSNPKTLKEFINNNNPIIRNRIENLIAQCRL

SEQ ID NO: 56 - protein, 776 aa, Artificial Sequence
  Rotavirus VP4 P[15] (inlcudes VP8* P[15])
MASLIYRQLLTNSYTVNLSDEIQLIGSEKTQRTTVNPGPFAQTGYAPVNWGPGETNDSTTVEPVLDGPYQPMTFNQPVEYWMLLAPTSEGVVVEGTNGTNRWLATILIEPNVPETTRNYTLFGETASISVANPSQSKWRFVDVVKTTANGTYSQYGPLLSDTKLYGVMKYNGKLYTYNGETPNATTKYYSTTNYDSVNMTSYCDFYIIPRAQESKCTEYVNNGLPPIQNTRNVVPLALSSRSIVARRAAVNEDIVISKASLWKEMQHNRDIIIRFKFANSIIKSGGLGYKWSEISFKPANYQYTYIRDGEEVTAHTTCSVNGVNDFNYNGGSLPTDFVISRYEGYKENSYVYIDYWDDSQAFRNMVYVRSLAADLNEVTCAGGTYNFQLPVGQWPVMSGGSVSLRSAGVTLSTQFTDFVSLNSLRFRFSLAVEEPPFSISRTRISGLYGLPAANPNNGRDFYEIAGRFSLISLVPSNDDYQTPIMNSVTVRQDLERQLGELREEFNALSQEIAMSQLIDLALLPLDMFSMFSGIKTTIDAAKSMATNVMKKFKSSGLATSVSTLTDSLSDAASAVSRNSSIRSIGSTASAWTDISSQIVDTQASVNTLATQTSTISKRLRLKEIATQTEGMNFDDISAAVLKTKIDKSSQIGPSTLPDIVTEASEKFIPNRTYRVIDDDTVFEAGTDGRFYAYRVETFEQVPFDVQKFADLVTDSPVISAIIGFKTLKNLNDNYGITRSQALNLIRSDPRVLREFINQDNPIIRNRIEQLILQCRL

SEQ ID NO: 57 - protein, 775 aa, Artificial Sequence
  Rotavirus VP4 P[16] (inlcudes VP8* P[16])
MASLIYRQLLTNSFTVDLSDEIETIGAEKTKNVTVNPGPFAQTGYAPVNWGPGETSNSTTVEPVLDGPYQPIAFSPPSEYYILLSPTVPGVVVECTNTVDRWIATIAIEPNVSKTKRTYTLFGITEQLTVENSYADKWKFIDFLKASTNGSYARYNILLSSTKLCAVAKHTDRLYSYIRETPNAGQAYYAFSHNIFNLTAHCDFYIIPWAQQSLCTQYINTGLPPIQNTRNVVARHLSARSIITRRAQANEDIVVSKTSLWKEMQFNRDITIRFKFANAIIKSGGLGYKWSEISFKPANYQYTYTRDGEEVTAHTTCSVNGVNNFDFFGGSLPTDFGISRYEVLKENSFVYIDYWDDSQAFRNMVYVRSLAADLNTIECTGGTYEFSLPVGQWPAMTGGAVSLRVAGVTLSTQYTDFVSLNSLRFRFRLSVEEPPFSITRTRVSGLYGLPAANPNNGKEYYELAGRFSLISLVPSNDNYQTPIMNSVTVRQDLERQLGELREEFNALSQEIALSQLVDLALLPLDMFSMFSGIKATLDVAKSMATNVMKKFKSSGLATSVSAMTESLSDAASSVSRSNTIRSISSTSSAWTDVSSRVADLDNAASTVSTQTATISRRLRLKEITTQTEGMNFDDISAAVLKIKLDKSAQIAPNTLPDIVTEASEKFIPNRSYRIINNNEAFEAGTDGRFFAYRVDTLEELPFDVQKFANLVTESPVISAIIDFKTLRNLNDNYGISKEQAFNLLRSDPRVLREFINQGNPIIRNRIEQLIMQCKL

SEQ ID NO: 58 - protein, 677 aa, Artificial Sequence
  Rotavirus VP4 P[17] (inlcudes VP8* P[17])
MASLVYRQLLANSYTSEIQDTIDDISAQKTESVTVNPGPFAQTGCAPVEWTHGDITTDETVEQTLDGPYAPSSVIVQPQYWVLMNPEKDGVIAEAGANNRKYACVLMPPNTGNGDKQYTILGKQITINLGNTDQSKYKFFDLVSTDGSTYSKIQELTTPHRLNAFMKDQGRLYVYIGIVPNISTGYYTLDDIEHVQTNIKCNYYIVSQSQTQQLEDFLKNGLPPIQNSRYVMPVARSISKIYRARPNEDIVISKTSLWKEMQYNRDIVIRFKIGNTIIKSGGLGYKWSEISFKPMNYEYTYERDGETVVAHTTCSVAGVNNFGYNSGSLPTDFVVSKYEVLKGNSYVYIDYWDDSQAFKNMVYVRSLSAEFNAISCTGGTFNFQLPVGQWPQMRGGNVTLNSDAVTLSTQYTDFVSLNSLRFRFKPSIGEPYFEITRTRETRLYGLPAANPMGGNDYYEAAGRFSLISLVPSNDDYQTPIQNSTTVRQDLEQQISNLREEFNQLSSEIAMSQLIDLALLPLDMFAMFSGIKSTLDAVKSMTTSVMKKMKTSTLAKSVSTITEELSDAATTVSRSSSIRSNASVWNNLVDSTTQTSNVANDVATQTSKIASKLRVKEFATQTDGGLSFNDISAAVLKTKIDKIESVQPKILPTIITESVDKFIPSRQYRIIDKDIACE

SEQ ID NO: 59 - protein, 776 aa, Artificial Sequence
  Rotavirus VP4 P[18] (inlcudes VP8* P[18])
MASLIYRQLLGNSYAVDLSDETQEIGASRNQNVTVNPGPFAQTNYAPVSWGPGEVRDSTTVEPLLDGPYQPTTFNPPVDYWMLLAPTDRGVVVEGTNNTNRWLAIILVEPDVPTEERTYTLFGQQAQITVANDSQLKWKFIVVSKQTLDGAYAQYGPLLSATKLYAVMKHSGRIYTYSGETPNATTAYYSTTNYDTVNMKAYCHFYIIPRTQESKCTEYINTGLPPIQNTRNVIPVSITSRDIQYTRAQVNEDILISKASLWKEMQYNRDIIIRFQIANSIVKSGGLGYKWSEISFKPANYQYSYIRDDEEVTSATTCSVNGVNEFSYSGGSLPTDFAVSKYEVIKENSFVYVDYWDDSQAFRNMVYVRSLAANLNSVMCTGGDFSFALPVGHYPVMTGGAVTLHSAGVTLSTQFTDFVSLNSLRFRFSLSVEEPPFSIIRTRVSGLYGLPATKPNNSQEYYEIAGRFSLISLVPSNDDYQTPIMNSVTVRQDLERQLSELRDEFNSLSQQIAMSQLIDLALLPLDMFSMFSGIKSTIDAAKSMVTNVMKKFKKSSLANSVSTLTNSLSDAASSVSRSSSIRSIGSTASAWTDVSITASDVSTATNSIATQTSTISKRLRLKEMATQTDGMNFDDISAEMLKTKIDKSTQITADTLPEMITEASEKFIPNRTYRIINNDEVFETSIDGKYFAYRVDTFEEIPFDVQKFADLVTDSPVISAIIDFKTLKKLNDNYGITKEQAFNLLRSDPKVLREFINQNNPIIKNRIENLIMQCRL

SEQ ID NO: 60 - protein, 775 aa, Artificial Sequence
  Rotavirus VP4 P[19] (VP8* P[19])
MASLIYRQLLTNSYTVDLSDEIALIGSEKTQSTTINPGPFAQTNYAPVNWGHGEISDSTTVEPVLDGPYQPVAFKPPNDYWILVNSNSNGVVLEGTNNTDVWVAIISIEPNVNSESRQYSLFGVNKQITVVNTSDKWKFMEMFRNNSNAEFQHKRTLTSSTKLVGILKHGGRLWTYHGETPNATTDYSTTSNLNEISVTTYAEFYIIPRSQESKCTEYINTGLPPIQNTRNVVPLSLTSRTVIHNRAQINEDIVISKASLWKEMQYNRDIVIRFKFNNSVIKLGGLGYKWSEVSFKAANYQYTYLRDGEQVTAHTTCSVNGVNNFSYNGGSLPTDFSISRYEVIKENSYVYIDYWDDSQAFRNMVYVRSLAANLNSVKCTGGNYNFQIPVGAWPVMSGGAVSLHFAGVTLSTQFTDFVSLNSLRFRFSLTVEEPSFSILRTRVSNLYGLPAANPNNGNDYYEIAGRFSLISLVPTNDDYQTPIMNSVTVRQDLERQLGDLREEFNSLSQEIAMSQLIDLALLPLDMFSMFSGIKSTVDIAKSMATNVMKKFKRSNLATSISDLTDSLSNAASSISRNSSIRSNVSSISVWTDVSNQIIDASSSVSSISTQTATISRRLRLKEMTTQTEGMNFDDISAAVLKTKIDRSTQISPNTLPDIVTEASEKFIPKRSYRVLKDDEVMEASVDGKFFAYKVDTFEEIPFDVNKFVDLVTDSPVISAIIDFKTLKNLNDNYGITRTQALDLIRSDPKVLRDFINQNNPIIRNRIEQLISQCRL

SEQ ID NO: 61 - protein, 776 aa, Artificial Sequence
  Rotavirus VP4 P[20] (inlcudes VP8* P[20])
MASLIYRQLLTNSFTVDLSDEIETIGSEKNQNVTINPGPFAQIGYAPVDWGPGETNDSTTVEPVLDGPYKPTSFNPPTDYWMLLSPSSPGAVVEGTNNTDRWLATILIEPNVASTTRTYTIFGSKEAITVENTSQNKWKFIDLAKTSLTGSYSQYGILLSKPKLYAIMKRSGYLYTYSGETPDAITDYYTTTNYDSVNMTAYCDFYIIPWAQEALCTQYINNGLPPIQNTRNVVARPLSSRSIVVRRAQANEDVVISKASLWKEMQYNRDITIRFKFANAIIKSGGLGYKWSEISFKPANYQYTYTRDGEEVTAHTTCSVNGVNNFDFFGGALPTDFVISRYEVIKENSFVYVDYWDDSQAFRNMMYVRSLAADLNSVMCTGGVYEFSLPVGQWPAMTGGAVSLRAAGVTLSTQFTDFVSLNSLRFRFRLSVEEPSFSITRTRVSGLYGLPAANPNNGREYYEVAGRFSLISLVPSNDDHQTPIMNSVTVRQDLERQLSELRDEFNALSQEIAMSQLIDLALLPLDMFSMFSGIKATFDAVKSMATSVMKKFKKSGLASSVSTLTDSLSDAASSMSRSGSIRSISSNSSVWTDVSSTLYDLPSYMSTVSTQTATISKRLRLKEITAQTEGMNFDDISAAVLKTKIDRSAQITPNTLPDIVTEASEKFIPNRSYRILNNNEAFETSTDGRFFAYRVDTFEEIPFDVQKFADLVTDLPVISAIIDFKTLKNLNDNYGITREQAFNLIRSDPRVLREFINQDNPIIRNRIEQLIMQCRL

SEQ ID NO: 62 - protein, 776 aa, Artificial Sequence
  Rotavirus VP4 P[21] (inlcudes VP8* P[21])
MGSFIYKQLLTNSYTVELSDEIDAIGSEKTQNVTINPGPFAQTGYAPVEWGAGETNDSTTIEPVLDGPYQPTRFNPEIGYWILLAPETQGIVLETTNTTNKWFATILIEQDVVAESRTYTIFGKTESIQAENTSQTEWKFIDIIKTTQDGTYSQYGPLVLSTKLYGVMKYGGRLYAYIGHTPNATPGHYTIANYDTMEMSIFCEFYIMPRSQEAQCTEYINSGLPPIQNTRNIVPLSLSSRSIKYQKAQVNEDIIISKTSLWKEMQYNIDIIIRFKFNNSIIKSGGLGYKWLEIAFKPANYQYNYIRDGENITAHTTCSVNGVNEFSYNGGSLPTDFAISRYEVIKENSYVYVDYWDDSQAFRNMVYVRSLAANLNTVICNGGDYSFQVPVGQWPVMSGGAVSLQSAGVTLSTQFTDFVSLNSLRFRFSLAVESPPFSITRTRVSNLYGLPAANPNGGRDFYEILGRFSLISLVPSNDDYQTPIMNSVTVRQDLDRQLGELRDEFNALSQQIAMSQLIDLALLPLDMFSMFSGIKGSIDVARSMATKVMKKFRNSKLASSVSTLTDSLSDAASSLSRTSTIRSIGSSASAWTNISSQVDDVISSTSEISTQTSTISRRLRVKEIATQTEGMNFDDISAAVLKAKIDRSTQIDSNTLPDIVTEASEKFIPNRAYRVMDGDEVLEASTDGKFFAYKVETFDEVPFDVQKFADLVTDSPVISAIIDFKTLKNLNDNYGITKAQAFNLLRSDPRVLREFINQENPIIRNRIEQLILQCKL

SEQ ID NO: 63 - protein, 295 aa, Artificial Sequence
  Rotavirus VP4 P[22] (inlcudes VP8* P[22])
MASLIYRRLLTNSFTTDLSDEIEEIGSSKSQNVTLNPGPFAQTGYAPVDWGPGETNDSTTIMPVLDGPYQPTTFNPPIEYWMLFAPNDQGVVAELTNNTDIWLVIILVEPNVPQGSRTYTIFGQQKSLMIENTSQTKWKFIDFIKESQGGTYVPNDTLLSETKLQAAMKYGQRLFTFIGNTPNSAPQERGYTTNNYSTINVTSLCDFYIVPRTPREVCRNYINHGLPPMQNTRNVVPVALSARDVRIQRVSANEDIAISKTSLWKEMQYNRDIIIRFKFANQIIKSGGLGYKWSE

SEQ ID NO: 64 - protein, 239 aa, Artificial Sequence
  Rotavirus VP4 P[23] (inlcudes VP8* P[23])
  misc_feature (232)..(232): Xaa can be any naturally occurring amino acid
SYTVDLSDEIQTIGSKKTQNVTINPGPFAQTGYAPVNWGPGETNDSTTVEPVLDGPYQPTTFNPPVSYWILLSPSNAGVVVEGTNNSDRWLATILIEPNVTSQSRTYTLFGHQEQITVENVSTTKWKFVDLAKTDINGTFTQHGPLLSDTKLHGVMKFSGRLYTYNGETPNATIGYYTTTNYDTVNMVSHCDFYIIPRSEENTCTNYINNGLPPIQNTRNVVPVSLTSRSIXHTRAQAN

SEQ ID NO: 65 - protein, 776 aa, Artificial Sequence
  Rotavirus VP4 P[24] (inlcudes VP8* P[24])
MASLIYRQLLANSYAVDLSDEIDIIGSEKTQNVTINPGPFAQTGYAPVNWGPGETNDSTTIEPILDGPYPPTTFNPPTGYWMLLSPLEAGVVVEGTNNSDRWLATILIEPNVAAETRTYTLFGVQEQISISNTSSTKWKFVDLVKTSLTGTYSQYGPLLSDTKLYGAMKYSGRIYTYEGETPNAATGYYSTTNYDSVNMTAFCDFYIIPRSQESTCTNYINNGLPPIQNTRNVVPVSLASRAIISHRAQANEDIIVSQTSLWKEMQYNRDITIRFKFANAIVKSGGLGYKWSEISFKPANYQYTYVRDGEEVTAHTTCSVNGINDFSYNGGSLPTDFGISRYEVIKENSYVYVDYWDDSQAFRNMVYVRSLAADLNSVMCTGGSYNFALPVGQWPVMTGGAVSLHSAGVTLSTQFTDFVSLNSLRFRFRLSVEEPPFSIVRTRISGLYGLPAADPNNGNEYYEIAGRFSLISLVPSNDDYQTPIMNSVTVRQDLERQLGELREEFNALSQEIAMSQLVDLALLPLDMFSMFSGIKSTIDAAKSMATNVMKKFKKSSLASSVSTLTDSLSDAASSMTRNSSIRSVGSSISAWTDVSSQLTDASASTSTIATQTATISRRLRLKEIATQTEGMNFDDISAAVLKTKIDRSVQISPSTLPDIVTEASEKFIPNRAYRVINNDEVFEAGMDGRFFAYRVETFEEIPFDVQRFADLVTDSPVISAIIDFKTLKNLNDNYGITRDQAFNLLRSDPRVLREFINQDNPIIRNRIEQLILQCRL

SEQ ID NO: 66 - protein, 772 aa, Artificial Sequence
  Rotavirus VP4 P[25] (VP8* P[25])
MASLIYRQLLSNSYITNLSDEITDIGNEKNSNVTVNPGPFSQTGYAPVDWGHGELPDSTLVQPVLDGPYQPTSFNLPVDYWMMMSPTQAGRVAEGTNGTDRWFACIIVEPNVSLQSRDYVLDGQIVQLQVDNTSNTMWKFILFIKLTKSGNYSQYSSLSTNHKLCAWIKRDGRVYWFDGTVPNSSDNYYLTINNDNSIISSDVDFYLIPRTQTDSCRRYINNGLPPIQNTRNVVSVKLSAREIPTVKAQMNEDIIISKTSLWKEMQYNRDITIRFKFDNSIVKSGGLGYKWSEISFKPKNYQYTYNRDGEEVTAHTTCSVNGVNDFSYNSGTLPTDFSISRFEVIKENSFVYVDYWDDSQAFRNMVYVRSLSANLNDVQCIGGNYDFVLPVGPWPIMSGGAVTLSFAGVTLSTQFTDYVSLNSLRFRFRLSVGEPSFSIIRTRMSGLYGLPAANPNNNVEYYEIAGRFSLISLVPSNDGYQTPIANSVTVRQDLDRQLSELRNEFNSLSQEIAISQLVDLATLPLDMFSMFSGLKSTFGAIRSLTTNVMKKFKNSNIARSISSLTDAMSDAASSINRSRSTRSITSNISTITQTSSEIESIADISTQVSSISRQLRLKEFSTQTDHMNFDDISAAVLKTKLNKSTQLSQDTIPDIISESSEKFIPSRTYRFIDDDNVFEASIDGTFYAYRVETLDEISFDMERFRKLVTDSPVISAIIDFKTLKNLNDNYGITKKQALDLIYSNPKTLKEFINNDNPIIRNRIENLIAQCRL

SEQ ID NO: 67 - protein, 776 aa, Artificial Sequence
  Rotavirus VP4 P[26] (inlcudes VP8* P[26])
MASLIYRQLLTNSYTTDLSDEIEEIGSSKSQDVTVNPGPFAQTGYAPVSWGPGETNDSTTVEPILDGPYQPTTFNPPIGYWVLFAPTVQGVVAEGTNNTSRWLAIILVEPNVSQETRTYTIFGQQVQLQVENVSQTKWKFIDVSKTSQGGSYTQYSTLLSNTKLDAVIKYGGKVFTYNGETPSATSGQYTTTNYEAIVMTLFCDFYIIPRTQEETCTNYINHGLPPIQNTRNVVPVALSARDISISKASVNEDIVVSKTSLWKEMQYNRDITIRFKFANQIIKSGGLGYKWSEISFKPATYQYTYIRDGEEVIAHTTCSVNGVNNFNYNGGSLPTDFVISRYEVIKENSYVYIDYWDDSQAFKNMVYVRALAADLNSIICSGGSYNFALPLGNFPVMSGGAVSLHPSGVTLSTQFTDFASFNSLRFRFRLAVEEPSFSISRTRITRLYGLPAVNPNNNKDFYEVEGRFSLISLVPSNDDYQTPIMNSVTVRQDLERQLGELRNEFNALSQQIAMSQLIDLALLPLDMFSMFSGIKGTIDIAKSMATNVMKKFRKSALANSVSTLTESLSDAASSISRGSTIRSVGSSVSAWTEVSSSVIDTTTATNTIATQTATISKRLRLKEIATQTDGMNFDDISAAVLKTKIDKSTQIAPNTLPDIVTEASEKFIPNRAYRVMNNDEVFEAGTDGRFFAYKVETFEEIPFDVQKFADLVTDSPVISAIIDFKTLKNLNDNYGITKQQAYNLLRSDPRVLREFINQDNPIIRNRIENLIMQCRL

SEQ ID NO: 68 - protein, 772 aa, Artificial Sequence
  Rotavirus VP4 P[27] (inlcudes VP8* P[27])
MASLIYRQLLTNSYTVDLSDEIEIIGSEKSVNVTVNPGPFAQTDYAPVDWGSGETSDSITVEPILDGPYQPTTFKPDINYWILLEPKNQDVIFETTNNIDQWIAAILIEPNTNTITKNYTLFGKQEQIEVSNASSKWKFVDLIKKTVDGSFTQRGPLLSDTKLYAVMKHGSQVFTYGGETPNAATVGYATLNYSELIIAVYCDFYIIPRAQEKQCTSFINNGLPPVQNTRNVTPVSIKARSITYQRAQANEDIIVSKTSLWKEMQYNRDIKIKFKFNNNIIKSSGLGYKWSEISFKPENYNYTYLRDGELVTAHTTCSVNGVYDFSFNSGPLPTDFVIHKYEVIKEGSFVYVDYWDDSQAFRNMVYVRSLAANLNSITCSGGDYTFKLPAGKHQVITGGSVMLHPAGVTLSTQFTDYVSLNSLRFRFSLEVLDPPFSILRTRVSRLYGLPAANPNNGKECYEIDGRFSLISLVPSNDDYQTPIMNSVTVRQDLEQQLNSLRDEFNKLSQEIAVSQLIDLALLPLDMFSMFAGIKSTVNAAKSMATSVMKKFKKSSLASAVSSLTDSLSDAASSISRSTSIKSIGSSTSVWTDISSQIVDVSNSVASQTSTISRRLRLKEIATQTEGVNFDDLSAAVLKAKIDKSAQVSVNTLPDIVTEASEKFIPNRSYRVIKNDEVLEAGTDGRFFAYRVDTFEEMPFDVQKFADLVTESPVISAIIDFKTLKNLNDNYGITREQAFNLLKSDPRVLREFINQNNPIIKNRIEQLILQCRL

SEQ ID NO: 69 - protein, 776 aa, Artificial Sequence
  Rotavirus VP4 P[28] (VP8* P[28])
MASLIYRQLLNNSYTVNLSEEIQELSTNKTQSTTVNPGPFAQTGYAPVNWGHGEINDSTTVEPTLDGPYQPTSFNPPINYWLLLSPTNAGVVMQGTNNTNRWLATLLVEPNVESTTRNYNLFGSSVDITVENTSSDKWKFIDVGKTSLNGSYVQHGTLISSTKLCAAMKHGGNLYTFSGTTPNALPKAYSTTNFDSVNVTTFADFYIISRDNEQKCRQYVNNGLPPIQNTRNVVPLDITSRDVQNIRAQMNEDIVVSKTSLWKEMQYNRDITLRFKFANSIVKSGGLGYKWSEISFKPANYQYTYTRDGEEVTAHTTCSVNGINDFNYNGGTLPTDFVVSKFEVIKENSYVYIDYWDDSQAFRNMVYVRSLSAEFNNVECTGGDYSFSLPVGQWPVMTGGAVTLSPAGVTLSTQFTDYVSLNSLRFRFRLTVGEPPFAILRTRMSGLYGLPAANPNNGKTFYETSGRFSLISLVPTNDNYQTPIVNSVTVRQDLDRQLAELRQEFNALSQEIAVSQLIDLALLPLDMFSMFSGIKSTVEAAKSMATNVMKKFKKSSLASSMATLTENLSDAASSVSRSGTLRSVSSTASAWTDVSTSVSDISSTVSSVSSQTSTISRRLRLKEIATQTEGLNFDDISAAVLKTKIDKSVQVAPHTLPDIVTEASEKFIPKRAYRVIKNDEVFEAGTDGLFYAYKVSTFNEIPFDVQKFADLVTDSPVISAIIDFKTLKNLNDNYGISKQQALNLLRSDPRVLREFINQNNPIIKHRIEQLIMQCRL

SEQ ID NO: 70 - protein, 777 aa, Artificial Sequence
  Rotavirus VP4 P[29] (inlcudes VP8* P[29])
MASLIYRQLLSNSYSTNISDEITELSQEKTQNVIVNPGPFAQTSFAPVDWGPGETPDSTLVQPVLDGPYQPIKFKPDNGNWLLLQPERPGVIMTGTDNANIWMAAIIIEPNLSAEQRTYRIYDEDVELLVDNASRTKWKIVDLYKTQQSGQYVRQNWRIYTAYKLYGIRIVDTKLQSYGGETPNLSIITTTVTNYSNVEITTLSNFFIISSNNTEKCTTYMNQGLEPIQNTTRVVSVPLENFYQTSNYLARPNQDIEVSKTSLWKEMQYNRDIIIRFRFENVIIKAGGLGYKWSEISYKASNYRYTYERDGEEIIAHTTCSVNGVNEYNYNGGSLPTDFSITRYDVLKENSFVYIDYWDDSQAFRNMVYVRSLVAELNNIYCDGGDYSFRVPVGEFPILKGGAITLVPAGVTLSTQFTDFVSLNSLRFRFKASVAEPSFRIIRTRVNSLYGLPAMNPNGNHDYYETAGRFSLISLVPSNDDYQIPIANSVTVRQDLERQLGELREEFNMLSQNIAVSQLIDLALLPLDMFSMFSGIKSTLEATKSMATSVMKRFKNTNIAKTITSITDDLSDAASSVSRRNTIRSIGSVRSAWSNTDNVSTSVIESVDVSTQVSRLSNRLRFKEMVTQTEGLNFDDISAAVLKTKVDKSTYVTSNTLPEIVSEAADSFIPARAYRVIVDDDVLEVGTDGRHFAYKVGTFDEVEFDLDKFAELVTDSPVISAIIDFKTIKNLNDNYGITKQQALNILKSDPKTLRDFVNQNNPIIRNRIEQLILQCRV

SEQ ID NO: 71 - protein, 770 aa, Artificial Sequence
  Rotavirus VP4 P[30] (inlcudes VP8* P[30])
MASLVYRQLLANSYTSELQDTIDDISAQKSQDVTINPGPFAQTGYAPVEWTHGDITTDETIEQTLDGPYTSSSIIIQPQYWILANPDTEGVIVEADATDQKYARVMLLPNTADGNKQYTILGHRVTINLGNTNSNMYKFCDLVSHNGTTYTKVEELVTPHGLNAFMKDQGKLYLYNGTVPNVQQVYYTLANIENVQTNIKCNYYIVPKTQTGQLEDYIKNGLPPIQESRYIVPVNRSVINVYQSRPNEDILISKTSLWKEVRYNRDILIRFKFGNNIIKSGGLGYKWSEISFKPMNYEYTYERDGETVVAHTTCSVAGINNFGYNSGSLPTDLVVSTYEVLKGNSYVYIDYWDDSQAFKNMVYVRSLSAEFNAISCNGGTFNFQLPVGQWPQMRGGNVTLNSDAVTLSTQYTDFVSLNSLRFRFKPAIGEPSFEITRTRERRLYGLPAANPMGNQEYYETAGRFSLISLVPSNDDYQTPIQNSTTVRQDLEQQITNLREEFNQLSSEIAVSQLVDLALLPLDMFSMFSGIKSTIDAVKSVTTSVMKKMKASTLAKSVSTITEELSDAATSISRSSSIRSNASVWNDLIDTATQTSYASSDVATQTSKIATKLRVKEFATQTDGGLNFNDISAAVLKTKIDKLDAVQPKLLPTIIADSVDKFIPSREYRIINKDIAYEISNSGRYFAYKVDTLEEVVFDVEKFANLVTDSPVISAIIDFRTIKNLNDNFGITGEQAYNNLRSDPRVLKEFINQNNPIIKNRIEQLILQCRI

SEQ ID NO: 72 - protein, 770 aa, Artificial Sequence
  Rotavirus VP4 P[31] (inlcudes VP8* P[31])
MASLVYRQLLANSYTSDLQDNIDDISAEKTQGVTINPGPFAQTGYAPVEWTHGDIPVDETIEPTLDGPYTASSIVIQPQYWILVNPTNQNVVIEADAQNKKFACVMLPPNTPESDRQYTILGKQITIRLGNTDTVNYKFCDLLSNDGITYTKSIELITPHRLNAFMKDAGKLYAYSGTVPTIKKEYHTLDNIENVQTNITCEYYIVPNSQVSTLEEYLKNGLPPIQQTRYILPVARNVASLYRAKPNEDIVVSKTSLWKEMQYNRDITIRFKFGNTIIKSGGLGYKWAEISFKPMNYEYTYERDGETVVAHTTCSVAGINNFGYNSGSLPTDFVVSRYEVLKGNSYVYIDYWDDSQAFRNMVYVRSLNAEFNPVSCTGGSFNFRLPVGNWPQMRGGNVTLHSDAVTLSTQYTDFVSLNSLRFRFKPEIGEPFFEITRTREKRLYGLPAANPMNGVDFYETKGRFSLISVVPSNDAYQTPIQNSTTVRQDLEQQITDLREEFNQLSSEIAVSQLIDLALLPLDMFSMFSGIKSTVSAVKSVTTSVMKKMKTSVLAKSVSTITEELSDAATSISRASSLKSTASVWNNLVDTATQASTATSDIATQTSKIANKLRVKEFAAQTDGGLNFNDISAAVLKTKIDNLDAVQPKILPTLVADSVDKFIPSREYRIFDKDIAYEISNNGRYFAYKVDTLEEVVFDVEKFANLVTDSPVISAIVDFRTLKNLNDNFGITKEQAYNLLRSDPRVLKEFINQNNPIIRNRIEQLILQCRI

SEQ ID NO: 73 - protein, 776 aa, Artificial Sequence
  Rotavirus VP4 P[32] (inlcudes VP8* P[32])
MASLIYRQLLNNSYTTDLSDEINEIGSLKSQDVTINPGPFAQTGYAPVNWGHGEINDSTTVEPVLDGPYQPTTFNPPVDYWLLFAPNTQGVIAEGTNNINRWLAIILVEPGVTQTTREYNVFGERIQLQVENTHQTKWKFIDISRANQSDSYAQYGPLLSDTKLYAAMKYNGLICTYVGETPNARTDQYSTTNYRDVEMTIFCDFYIIPRAQENICTNYINNGLPPIQNTRNVVPVALSSRDITTSRASVNEDIVISKTSLWKEMQYNRDITIRFKFANRIIKSGGLGYKWSEISFKPIDYQYTYDRNGETVTAHTTCSVNGVNNFSYNGGSLPTDFVISRYEVIKENSYVYVDYWDDSQAFRNMVYVRSLAAELNSVTCNGGSYNFALPVGHYPVMSGGAVILHSAGVTLSTQFTDYVSLNSLRFRFRLEVAEPFFSISRTRVSRLYGLPAVNPNGSRDFYEIMGRFSLISLVPSNDDYQTPIMNSVTVRQDLERQLGELRNEFNALSQQIAMSQLIDLATLPLDMFSMFSGIKGTIDIAKSMATNVMKKFKRSKLASSVSTLTESLSDAASSISRSSTIRSIGSSASAWTEISTSAVDASTTMNSIATQTATISRRLRLKEIATQTDGMNFDDISAAVLKTKIDKSVQIAPNTLPDIVTEASEKFIPNRTYRVINNDEVFEASTDGKFFAYKVDTFNEIPFDVQKFADLVTDSPVISAIIDFKTIKNLNDNYGISKQQAFNLLKSDPRVLREFINQDNPIIRNRIENLIMQCRL

SEQ ID NO: 74 - protein, 774 aa, Artificial Sequence
  Rotavirus VP4 P[33] (inlcudes VP8* P[33])
MASLIFRQLLNNSYTVNISDEIQEVGSEKTQNVTINPGPFAQTGYAPVDWGPGEINDSTTVVPVIDGPYQPTEFDPPIDYWILMSPDSHGVVAEATNNENRWLAVILIEPGVNQETRNYNIFGKQEQLVVSNTSSTQWKFVDAIKTSEDGSYNQHGQLLSTNKLYAVMKSGGRVYTYEGTTPNARTGFYTTSNYSTVKVNVLCDFYIIPLAQESKCTEYINNGLPPIQNTRNVVPLSITSREIVETRAQVNEDIIISKSSLWKEMQYNRDIVIRFKFNNAIVKSGGLGYKWAELSFKPMNYTYNYDRDGEIVTAHTTCSVNGVNDFSYNGGSLPTDFAISKYEVIKENSFVYIDYWDDSQAFRNMVYVRSLAANLNTVKCAGGHFSFQLPVGDWPVMSGGAVILHSAGVTLSTQFTDFVSLNSLRFRFNLSVEEPPFSISRTRVNGLYGLPAAKPNGDSEFYEILGRFSLISLVPSNDDYQTPIMNSVTVRQDLDRQLGELREEFNTLSQQIAMSQLIDLATLPLDMFSMFSGIKSTVDAAKSMATNVMKRFKRSKLAESVSELTDSLSNAASSVSRTQTMRSVGSTASAWTSTVTNEVPEVSNTISTQTSIISRRLRLKEMTTQTEGLNFDDISAAVLKTKVDKSVQITPNTIPEIVTEASEKFIPNRSYRVIDNDSVFEAGTDGRFFAYRVETFEEIPFDVQKFADLVSDSPVISAIIDFKTIKNLNDNYGITKQQAFNLLRSDPRVLREFINQENPIIKNRIENLIMQCRL

SEQ ID NO: 75 - protein, 773 aa, Artificial Sequence
  Rotavirus VP4 P[34] (inlcudes VP8* P[34])
MASLIYRQLLANSYTVDLSDEIEVIGSERSSNVTINPGPFAQTSYAPVDWGSGEINDSTTVEPVLDGPYQPTTFKPDVDYWLLLEPKNDGVVFETTNGTNKWIAAIMIEPSTISVTKNYTLFGQQEQVQVSNTSTTKWKLVELVKQTQNGVYTQHGELLSDTKLYGVMKYGGLVCTYKGETPNATTDQYTTSNYSELSIAVHCDFYIISRAQEAECTRYINYGLPPIQNTRNVVPVSIKAKSIVYQRAQANEDIMVSKTSLWKEMQYNRDIKIKFKFNNTIVKSSGLGYKWSEISFKPENYNYTYLRDGELVTAHTTCSVNGVYDFNFNSGSLPTDFVIHKYEVIKEGSYVYVDYWDDSQAFRNMVYVRSLAANLNSVTCNGGDYVFRLPVGQHPVMTGGAVILHPAGVTLSTQFTDFVSLNSLRFRFSLEVLDPPFSILKTRVSRLYGLPAANPNNDREWYEVDGRFSLISLVPSNDDYQTPIMNSVTVRQDLERQLNSLRDEFNKLSQEIAVSQLIDLALLPLDMFSMFAGIKSTVNAAKSMATSVMKKFKRSSLASSISSLTDSLSDAASSISRNTSFRSVGSSVSVWTDVSSQVADTASSIANQTSTISRRLRLKEMATQTEGMNFDDLSAAVLKTKIDRSSQVSINTLPDVVTEASEKFIPNRSYRVIKDDEVLEASTDGKFFAYKVDTFEEIPFDVQKFADLVTESPVISAIIDFKTLKNLNDNYGITREQAFNLLRSDPRVLREFINQNNPIIKNRIEQLILQCRL

SEQ ID NO: 76 - protein, 770 aa, Artificial Sequence
  Rotavirus VP4 P[35] (inlcudes VP8* P[35])
MASLVYRQLLANSYTSEIQDTIDDISAQKTESVTVNPGPFAQTGYVPVEWTHGDITTDETVEQTLDGPYAPSSVIVQPQYWVLMNPEKDGVIAEADVNNRKYACVLMPPNTGNGDKQYTILGKQITINLGNTDQSKYKFFDLVSTDGSTYSKIQELTTPHRLNAFMKDQGRLYVYNGIVPNISTGYYTLDDIEHVQTNIKCNYYIVSQSQTQQLEDFLKNGLPPIQNSRYVMPVARSISKIYRARPNEDIVISKTSLWKEMQYNRDIVIRFKIGNTIIKSGGLGYKWSEISFKPMNYEYTYERDGETVVAHTTCSVAGVNNFGYNSGSLPTDFVVSKYEVLKGNSYVYIDYWDDSQAFKNMVYVRSLSAEFNAISCTGGTFNFQLPVGQWPQMRGGNVTLNSDAVTLSTQYTDFVSLNSLRFRFKPSIGEPYFEITRTRETRLYGLPAANPMGGNDYYEAAGRFSLISLVPSNDDYQTPIQNSTTVRQDLEQQISNLREEFNQLSSEIAMSQLIDLALLPLDMFAMFSGIKSTLDAVKSMTTSVMKKMKTSTLAKSVSTITEELSDAATTVSRSSSIRSNASVWNNLVDSTTQTSNVANDVATQTSKIASKLRVKEFATQTDGGLSFNDISAAVLKTKIDKIESVQPKILPTIITESVDKFIPSRQYRIIDKDIAYEISNSGKYFAYKVDTFEEVIFDVEKFADLVTDSPVISAIIDFKTLKNLNDNFGITREQAYNLLRSDPRVLKDFINQNNPIIKNRIEQLILQCRI

SEQ ID NO: 77 - protein, 240 aa, Artificial Sequence; identical to SEQ ID NO: 45
  VP8* aa2-240 long P[4]

SEQ ID NO: 78 - protein, 240 aa, Artificial Sequence; identical to SEQ ID NO: 47
  VP8* aa2-240 long P[6]

SEQ ID NO: 79 - protein, 240 aa, Artificial Sequence; identical to SEQ ID NO: 41
  VP8* aa2-240 long P[8]

SEQ ID NO: 80 - protein, 240 aa, Artificial Sequence; identical to SEQ ID NO: 49
  VP8* aa2-240 long P[8]-VirWa

SEQ ID NO: 81 - protein, 260 aa, Artificial Sequence
  VP8* aa2-240 long P[4] P2+Linker
MQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 82 - protein, 260 aa, Artificial Sequence
  VP8* aa2-240 long P[6] P2+Linker
MQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 83 - protein, 260 aa, Artificial Sequence
  VP8* aa2-240 long P[8] P2+Linker
MQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 84 - protein, 260 aa, Artificial Sequence
  VP8* aa2-240 long P[8]-VirWa P2+Linker
MQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 85 - protein, 260 aa, Artificial Sequence
  VP8* aa2-240 long P[4] SP(TPA)
MDAMKRGLCCVLLLCGAVFVSASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 86 - protein, 260 aa, Artificial Sequence
  VP8* aa2-240 long P[6] SP(TPA)
MDAMKRGLCCVLLLCGAVFVSASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 87 - protein, 260 aa, Artificial Sequence
  VP8* aa2-240 long P[8] SP(TPA)
MDAMKRGLCCVLLLCGAVFVSASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 88 - protein, 260 aa, Artificial Sequence
  VP8* aa2-240 long P[8]-VirWa SP(TPA)
MDAMKRGLCCVLLLCGAVFVSASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 89 - protein, 257 aa, Artificial Sequence
  VP8* aa2-240 long P[4] SP(HSA)
MKWVTFISLLFLFSSAYSASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 90 - protein, 257 aa, Artificial Sequence
  VP8* aa2-240 long P[6] SP(HSA)
MKWVTFISLLFLFSSAYSASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 91 - protein, 257 aa, Artificial Sequence
  VP8* aa2-240 long P[8] SP(HSA)
MKWVTFISLLFLFSSAYSASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 92 - protein, 257 aa, Artificial Sequence
  VP8* aa2-240 long P[8]-VirWa SP(HSA)
MKWVTFISLLFLFSSAYSASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 93 - protein, 257 aa, Artificial Sequence
  VP8* aa2-240 long P[4] SP(IgE)
MDWTWILFLVAAATRVHSASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 94 - protein, 257 aa, Artificial Sequence
  VP8* aa2-240 long P[6] SP(IgE)
MDWTWILFLVAAATRVHSASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 95 - protein, 257 aa, Artificial Sequence
  VP8* aa2-240 long P[8] SP(IgE)
MDWTWILFLVAAATRVHSASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 96 - protein, 257 aa, Artificial Sequence
  VP8* aa2-240 long P[8]-VirWa SP(IgE)
MDWTWILFLVAAATRVHSASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 97 - protein, 263 aa, Artificial Sequence
  VP8* aa2-240 long P[4] SP(CD5)
MPMGSLQPLATLYLLGMLVASCLGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 98 - protein, 263 aa, Artificial Sequence
  VP8* aa2-240 long P[6] SP(CD5)
MPMGSLQPLATLYLLGMLVASCLGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 99 - protein, 263 aa, Artificial Sequence
  VP8* aa2-240 long P[8] SP(CD5)
MPMGSLQPLATLYLLGMLVASCLGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 100 - protein, 263 aa, Artificial Sequence
  VP8* aa2-240 long P[8]-VirWa SP(CD5)
MPMGSLQPLATLYLLGMLVASCLGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 101 - protein, 263 aa, Artificial Sequence
  VP8* aa2-240 long P[4] SP(HLA-A2)
MAVMAPRTLVLLLSGALALTQTWAASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 102 - protein, 263 aa, Artificial Sequence
  VP8* aa2-240 long P[6] SP(HLA-A2)
MAVMAPRTLVLLLSGALALTQTWAASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 103 - protein, 263 aa, Artificial Sequence
  VP8* aa2-240 long P[8] SP(HLA-A2)
MAVMAPRTLVLLLSGALALTQTWAASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 104 - protein, 263 aa, Artificial Sequence
  VP8* aa2-240 long P[8]-VirWa SP(HLA-A2)
MAVMAPRTLVLLLSGALALTQTWAASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 105 - protein, 280 aa, Artificial Sequence
  VP8* aa2-240 long P[4] SP(TPA)+P2+Linker
MDAMKRGLCCVLLLCGAVFVSQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 106 - protein, 280 aa, Artificial Sequence
  VP8* aa2-240 long P[6] SP(TPA)+P2+Linker
MDAMKRGLCCVLLLCGAVFVSQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 107 - protein, 280 aa, Artificial Sequence
  VP8* aa2-240 long P[8] SP(TPA)+P2+Linker
MDAMKRGLCCVLLLCGAVFVSQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 108 - protein, 280 aa, Artificial Sequence
  VP8* aa2-240 long P[8]-VirWa SP(TPA)+P2+Linker
MDAMKRGLCCVLLLCGAVFVSQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 109 - protein, 277 aa, Artificial Sequence
  VP8* aa2-240 long P[4] SP(HSA)+P2+Linker
MKWVTFISLLFLFSSAYSQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 110 - protein, 277 aa, Artificial Sequence
  VP8* aa2-240 long P[6] SP(HSA)+P2+Linker
MKWVTFISLLFLFSSAYSQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 111 - protein, 277 aa, Artificial Sequence
  VP8* aa2-240 long P[8] SP(HSA)+P2+Linker
MKWVTFISLLFLFSSAYSQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 112 - protein, 277 aa, Artificial Sequence
  VP8* aa2-240 long P[8]-VirWa SP(HSA)+P2+Linker
MKWVTFISLLFLFSSAYSQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 113 - protein, 277 aa, Artificial Sequence
  VP8* aa2-240 long P[4] SP(IgE)+P2+Linker
MDWTWILFLVAAATRVHSQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 114 - protein, 277 aa, Artificial Sequence
  VP8* aa2-240 long P[6] SP(IgE)+P2+Linker
MDWTWILFLVAAATRVHSQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 115 - protein, 277 aa, Artificial Sequence
  VP8* aa2-240 long P[8] SP(IgE)+P2+Linker
MDWTWILFLVAAATRVHSQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 116 - protein, 277 aa, Artificial Sequence
  VP8* aa2-240 long P[8]-VirWa SP(IgE)+P2+Linker
MDWTWILFLVAAATRVHSQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 117 - protein, 283 aa, Artificial Sequence
  VP8* aa2-240 long P[4] SP(CD5)+P2+Linker
MPMGSLQPLATLYLLGMLVASCLGQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 118 - protein, 283 aa, Artificial Sequence
  VP8* aa2-240 long P[6] SP(CD5)+P2+Linker
MPMGSLQPLATLYLLGMLVASCLGQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 119 - protein, 283 aa, Artificial Sequence
  VP8* aa2-240 long P[8] SP(CD5)+P2+Linker
MPMGSLQPLATLYLLGMLVASCLGQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 120 - protein, 283 aa, Artificial Sequence
  VP8* aa2-240 long P[8]-VirWa SP(CD5)+P2+Linker
MPMGSLQPLATLYLLGMLVASCLGQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 121 - protein, 283 aa, Artificial Sequence
  VP8* aa2-240 long P[4] SP(HLA-A2)+P2+Linker
MAVMAPRTLVLLLSGALALTQTWAQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 122 - protein, 283 aa, Artificial Sequence
  VP8* aa2-240 long P[6] SP(HLA-A2)+P2+Linker
MAVMAPRTLVLLLSGALALTQTWAQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 123 - protein, 283 aa, Artificial Sequence
  VP8* aa2-240 long P[8] SP(HLA-A2)+P2+Linker
MAVMAPRTLVLLLSGALALTQTWAQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 124 - protein, 283 aa, Artificial Sequence
  VP8* aa2-240 long P[8]-VirWa SP(HLA-A2)+P2+Linker
MAVMAPRTLVLLLSGALALTQTWAQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 125 - protein, 240 aa, Artificial Sequence
  VP8* aa2-240 long P[4] w/o glyco
MASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 126 - protein, 240 aa, Artificial Sequence
  VP8* aa2-240 long P[6] w/o glyco
MASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 127 - protein, 240 aa, Artificial Sequence
  VP8* aa2-240 long P[8] w/o glyco
MASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 128 - protein, 240 aa, Artificial Sequence
  VP8* aa2-240 long P[8]-VirWa w/o glyco
MASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 129 - protein, 260 aa, Artificial Sequence
  VP8* aa2-240 long P[4] P2+Linker w/o glyco
MQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 130 - protein, 260 aa, Artificial Sequence
  VP8* aa2-240 long P[6] P2+Linker w/o glyco
MQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 131 - protein, 260 aa, Artificial Sequence
  VP8* aa2-240 long P[8] P2+Linker w/o glyco
MQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 132 - protein, 260 aa, Artificial Sequence
  VP8* aa2-240 long P[8]-VirWa P2+Linker w/o glyco
MQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 133 - protein, 260 aa, Artificial Sequence
  VP8* aa2-240 long P[4] SP(TPA) w/o glyco
MDAMKRGLCCVLLLCGAVFVSASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 134 - protein, 260 aa, Artificial Sequence
  VP8* aa2-240 long P[6] SP(TPA) w/o glyco
MDAMKRGLCCVLLLCGAVFVSASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 135 - protein, 260 aa, Artificial Sequence
  VP8* aa2-240 long P[8] SP(TPA) w/o glyco
MDAMKRGLCCVLLLCGAVFVSASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 136 - protein, 260 aa, Artificial Sequence
  VP8* aa2-240 long P[8]-VirWa SP(TPA) w/o glyco
MDAMKRGLCCVLLLCGAVFVSASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 137 - protein, 257 aa, Artificial Sequence
  VP8* aa2-240 long P[4] SP(HSA) w/o glyco
MKWVTFISLLFLFSSAYSASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 138 - protein, 257 aa, Artificial Sequence
  VP8* aa2-240 long P[6] SP(HSA) w/o glyco
MKWVTFISLLFLFSSAYSASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 139 - protein, 257 aa, Artificial Sequence
  VP8* aa2-240 long P[8] SP(HSA) w/o glyco
MKWVTFISLLFLFSSAYSASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 140 - protein, 257 aa, Artificial Sequence
  VP8* aa2-240 long P[8]-VirWa SP(HSA) w/o glyco
MKWVTFISLLFLFSSAYSASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 141 - protein, 257 aa, Artificial Sequence
  VP8* aa2-240 long P[4] SP(IgE) w/o glyco
MDWTWILFLVAAATRVHSASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 142 - protein, 257 aa, Artificial Sequence
  VP8* aa2-240 long P[6] SP(IgE) w/o glyco
MDWTWILFLVAAATRVHSASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 143 - protein, 257 aa, Artificial Sequence
  VP8* aa2-240 long P[8] SP(IgE) w/o glyco
MDWTWILFLVAAATRVHSASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 144 - protein, 257 aa, Artificial Sequence
  VP8* aa2-240 long P[8]-VirWa SP(IgE) w/o glyco
MDWTWILFLVAAATRVHSASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 145 - protein, 263 aa, Artificial Sequence
  VP8* aa2-240 long P[4] SP(CD5) w/o glyco
MPMGSLQPLATLYLLGMLVASCLGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 146 - protein, 263 aa, Artificial Sequence
  VP8* aa2-240 long P[6] SP(CD5) w/o glyco
MPMGSLQPLATLYLLGMLVASCLGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 147 - protein, 263 aa, Artificial Sequence
  VP8* aa2-240 long P[8] SP(CD5) w/o glyco
MPMGSLQPLATLYLLGMLVASCLGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 148 - protein, 263 aa, Artificial Sequence
  VP8* aa2-240 long P[8]-VirWa SP(CD5) w/o glyco
MPMGSLQPLATLYLLGMLVASCLGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 149 - protein, 263 aa, Artificial Sequence
  VP8* aa2-240 long P[4] SP(HLA-A2) w/o glyco
MAVMAPRTLVLLLSGALALTQTWAASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 150 - protein, 263 aa, Artificial Sequence
  VP8* aa2-240 long P[6] SP(HLA-A2) w/o glyco
MAVMAPRTLVLLLSGALALTQTWAASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 151 - protein, 263 aa, Artificial Sequence
  VP8* aa2-240 long P[8] SP(HLA-A2) w/o glyco
MAVMAPRTLVLLLSGALALTQTWAASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 152 - protein, 263 aa, Artificial Sequence
  VP8* aa2-240 long P[8]-VirWa SP(HLA-A2) w/o glyco
MAVMAPRTLVLLLSGALALTQTWAASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 153 - protein, 280 aa, Artificial Sequence
  VP8* aa2-240 long P[4] SP(TPA)+P2+Linker w/o glyco
MDAMKRGLCCVLLLCGAVFVSQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 154 - protein, 280 aa, Artificial Sequence
  VP8* aa2-240 long P[6] SP(TPA)+P2+Linker w/o glyco
MDAMKRGLCCVLLLCGAVFVSQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 155 - protein, 280 aa, Artificial Sequence
  VP8* aa2-240 long P[8] SP(TPA)+P2+Linker w/o glyco
MDAMKRGLCCVLLLCGAVFVSQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 156 - protein, 280 aa, Artificial Sequence
  VP8* aa2-240 long P[8]-VirWa SP(TPA)+P2+Linker w/o glyco
MDAMKRGLCCVLLLCGAVFVSQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 157 - protein, 277 aa, Artificial Sequence
  VP8* aa2-240 long P[4] SP(HSA)+P2+Linker w/o glyco
MKWVTFISLLFLFSSAYSQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 158 - protein, 277 aa, Artificial Sequence
  VP8* aa2-240 long P[6] SP(HSA)+P2+Linker w/o glyco
MKWVTFISLLFLFSSAYSQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 159 - protein, 277 aa, Artificial Sequence
  VP8* aa2-240 long P[8] SP(HSA)+P2+Linker w/o glyco
MKWVTFISLLFLFSSAYSQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 160 - protein, 277 aa, Artificial Sequence
  VP8* aa2-240 long P[8]-VirWa SP(HSA)+P2+Linker w/o glyco
MKWVTFISLLFLFSSAYSQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 161 - protein, 277 aa, Artificial Sequence
  VP8* aa2-240 long P[4] SP(IgE)+P2+Linker w/o glyco
MDWTWILFLVAAATRVHSQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 162 - protein, 277 aa, Artificial Sequence
  VP8* aa2-240 long P[6] SP(IgE)+P2+Linker w/o glyco
MDWTWILFLVAAATRVHSQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 163 - protein, 277 aa, Artificial Sequence
  VP8* aa2-240 long P[8] SP(IgE)+P2+Linker w/o glyco
MDWTWILFLVAAATRVHSQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 164 - protein, 277 aa, Artificial Sequence
  VP8* aa2-240 long P[8]-VirWa SP(IgE)+P2+Linker w/o glyco
MDWTWILFLVAAATRVHSQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 165 - protein, 283 aa, Artificial Sequence
  VP8* aa2-240 long P[4] SP(CD5)+P2+Linker w/o glyco
MPMGSLQPLATLYLLGMLVASCLGQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 166 - protein, 283 aa, Artificial Sequence
  VP8* aa2-240 long P[6] SP(CD5)+P2+Linker w/o glyco
MPMGSLQPLATLYLLGMLVASCLGQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 167 - protein, 283 aa, Artificial Sequence
  VP8* aa2-240 long P[8] SP(CD5)+P2+Linker w/o glyco
MPMGSLQPLATLYLLGMLVASCLGQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 168 - protein, 283 aa, Artificial Sequence
  VP8* aa2-240 long P[8]-VirWa SP(CD5)+P2+Linker w/o glyco
MPMGSLQPLATLYLLGMLVASCLGQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 169 - protein, 283 aa, Artificial Sequence
  VP8* aa2-240 long P[4] SP(HLA-A2)+P2+Linker w/o glyco
MAVMAPRTLVLLLSGALALTQTWAQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 170 - protein, 283 aa, Artificial Sequence
  VP8* aa2-240 long P[6] SP(HLA-A2)+P2+Linker w/o glyco
MAVMAPRTLVLLLSGALALTQTWAQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 171 - protein, 283 aa, Artificial Sequence
  VP8* aa2-240 long P[8] SP(HLA-A2)+P2+Linker w/o glyco
MAVMAPRTLVLLLSGALALTQTWAQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 172 - protein, 283 aa, Artificial Sequence
  VP8* aa2-240 long P[8]-VirWa SP(HLA-A2)+P2+Linker w/o glyco
MAVMAPRTLVLLLSGALALTQTWAQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 173 - protein, 230 aa, Artificial Sequence
  VP8* aa2-230 P[4]
MASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 174 - protein, 230 aa, Artificial Sequence
  VP8* aa2-230 P[6]
MASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 175 - protein, 230 aa, Artificial Sequence
  VP8* aa2-230 P[8]
MASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 176 - protein, 230 aa, Artificial Sequence
  VP8* aa2-230 P[8]-VirWa
MASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 177 - protein, 250 aa, Artificial Sequence
  VP8* aa2-230 P[4] P2+Linker
MQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 178 - protein, 250 aa, Artificial Sequence
  VP8* aa2-230 P[6] P2+Linker
MQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 179 - protein, 250 aa, Artificial Sequence
  VP8* aa2-230 P[8] P2+Linker
MQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 180 - protein, 250 aa, Artificial Sequence
  VP8* aa2-230 P[8]-VirWa P2+Linker
MQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 181 - protein, 250 aa, Artificial Sequence
  VP8* aa2-230 P[4] SP(TPA)
MDAMKRGLCCVLLLCGAVFVSASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 182 - protein, 250 aa, Artificial Sequence
  VP8* aa2-230 P[6] SP(TPA)
MDAMKRGLCCVLLLCGAVFVSASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 183 - protein, 250 aa, Artificial Sequence
  VP8* aa2-230 P[8] SP(TPA)
MDAMKRGLCCVLLLCGAVFVSASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 184 - protein, 250 aa, Artificial Sequence
  VP8* aa2-230 P[8]-VirWa SP(TPA)
MDAMKRGLCCVLLLCGAVFVSASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 185 - protein, 247 aa, Artificial Sequence
  VP8* aa2-230 P[4] SP(HSA)
MKWVTFISLLFLFSSAYSASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 186 - protein, 247 aa, Artificial Sequence
  VP8* aa2-230 P[6] SP(HSA)
MKWVTFISLLFLFSSAYSASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 187 - protein, 247 aa, Artificial Sequence
  VP8* aa2-230 P[8] SP(HSA)
MKWVTFISLLFLFSSAYSASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 188 - protein, 247 aa, Artificial Sequence
  VP8* aa2-230 P[8]-VirWa SP(HSA)
MKWVTFISLLFLFSSAYSASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 189 - protein, 247 aa, Artificial Sequence
  VP8* aa2-230 P[4] SP(IgE)
MDWTWILFLVAAATRVHSASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 190 - protein, 247 aa, Artificial Sequence
  VP8* aa2-230 P[6] SP(IgE)
MDWTWILFLVAAATRVHSASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 191 - protein, 247 aa, Artificial Sequence
  VP8* aa2-230 P[8] SP(IgE)
MDWTWILFLVAAATRVHSASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 192 - protein, 247 aa, Artificial Sequence
  VP8* aa2-230 P[8]-VirWa SP(IgE)
MDWTWILFLVAAATRVHSASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 193 - protein, 253 aa, Artificial Sequence
  VP8* aa2-230 P[4] SP(CD5)
MPMGSLQPLATLYLLGMLVASCLGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 194 - protein, 253 aa, Artificial Sequence
  VP8* aa2-230 P[6] SP(CD5)
MPMGSLQPLATLYLLGMLVASCLGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 195 - protein, 253 aa, Artificial Sequence
  VP8* aa2-230 P[8] SP(CD5)
MPMGSLQPLATLYLLGMLVASCLGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 196 - protein, 253 aa, Artificial Sequence
  VP8* aa2-230 P[8]-VirWa SP(CD5)
MPMGSLQPLATLYLLGMLVASCLGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 197 - protein, 253 aa, Artificial Sequence
  VP8* aa2-230 P[4] SP(HLA-A2)
MAVMAPRTLVLLLSGALALTQTWAASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 198 - protein, 253 aa, Artificial Sequence
  VP8* aa2-230 P[6] SP(HLA-A2)
MAVMAPRTLVLLLSGALALTQTWAASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 199 - protein, 253 aa, Artificial Sequence
  VP8* aa2-230 P[8] SP(HLA-A2)
MAVMAPRTLVLLLSGALALTQTWAASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 200 - protein, 253 aa, Artificial Sequence
  VP8* aa2-230 P[8]-VirWa SP(HLA-A2)
MAVMAPRTLVLLLSGALALTQTWAASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 201 - protein, 270 aa, Artificial Sequence
  VP8* aa2-230 P[4] SP(TPA)+P2+Linker
MDAMKRGLCCVLLLCGAVFVSQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 202 - protein, 270 aa, Artificial Sequence
  VP8* aa2-230 P[6] SP(TPA)+P2+Linker
MDAMKRGLCCVLLLCGAVFVSQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 203 - protein, 270 aa, Artificial Sequence
  VP8* aa2-230 P[8] SP(TPA)+P2+Linker
MDAMKRGLCCVLLLCGAVFVSQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 204 - protein, 270 aa, Artificial Sequence
  VP8* aa2-230 P[8]-VirWa SP(TPA)+P2+Linker
MDAMKRGLCCVLLLCGAVFVSQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 205 - protein, 267 aa, Artificial Sequence
  VP8* aa2-230 P[4] SP(HSA)+P2+Linker
MKWVTFISLLFLFSSAYSQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 206 - protein, 267 aa, Artificial Sequence
  VP8* aa2-230 P[6] SP(HSA)+P2+Linker
MKWVTFISLLFLFSSAYSQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 207 - protein, 267 aa, Artificial Sequence
  VP8* aa2-230 P[8] SP(HSA)+P2+Linker
MKWVTFISLLFLFSSAYSQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 208 - protein, 267 aa, Artificial Sequence
  VP8* aa2-230 P[8]-VirWa SP(HSA)+P2+Linker
MKWVTFISLLFLFSSAYSQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 209 - protein, 267 aa, Artificial Sequence
  VP8* aa2-230 P[4] SP(IgE)+P2+Linker
MDWTWILFLVAAATRVHSQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 210 - protein, 267 aa, Artificial Sequence
  VP8* aa2-230 P[6] SP(IgE)+P2+Linker
MDWTWILFLVAAATRVHSQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 211 - protein, 267 aa, Artificial Sequence
  VP8* aa2-230 P[8] SP(IgE)+P2+Linker
MDWTWILFLVAAATRVHSQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 212 - protein, 267 aa, Artificial Sequence
  VP8* aa2-230 P[8]-VirWa SP(IgE)+P2+Linker
MDWTWILFLVAAATRVHSQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 213 - protein, 273 aa, Artificial Sequence
  VP8* aa2-230 P[4] SP(CD5)+P2+Linker
MPMGSLQPLATLYLLGMLVASCLGQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 214 - protein, 273 aa, Artificial Sequence
  VP8* aa2-230 P[6] SP(CD5)+P2+Linker
MPMGSLQPLATLYLLGMLVASCLGQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 215 - protein, 273 aa, Artificial Sequence
  VP8* aa2-230 P[8] SP(CD5)+P2+Linker
MPMGSLQPLATLYLLGMLVASCLGQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 216 - protein, 273 aa, Artificial Sequence
  VP8* aa2-230 P[8]-VirWa SP(CD5)+P2+Linker
MPMGSLQPLATLYLLGMLVASCLGQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 217 - protein, 273 aa, Artificial Sequence
  VP8* aa2-230 P[4] SP(HLA-A2)+P2+Linker
MAVMAPRTLVLLLSGALALTQTWAQYIKANSKFIGITELGSGSGASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTR

SEQ ID NO: 218 - protein, 273 aa, Artificial Sequence
  VP8* aa2-230 P[6] SP(HLA-A2)+P2+Linker
MAVMAPRTLVLLLSGALALTQTWAQYIKANSKFIGITELGSGSGASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTR

SEQ ID NO: 219 - protein, 273 aa, Artificial Sequence
  VP8* aa2-230 P[8] SP(HLA-A2)+P2+Linker
MAVMAPRTLVLLLSGALALTQTWAQYIKANSKFIGITELGSGSGASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTR

SEQ ID NO: 220 - protein, 273 aa, Artificial Sequence
  VP8* aa2-230 P[8]-VirWa SP(HLA-A2)+P2+Linker
MAVMAPRTLVLLLSGALALTQTWAQYIKANSKFIGITELGSGSGASLIYRQLLTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTR

SEQ ID NO: 221 - protein, 230 aa, Artificial Sequence
  VP8* aa2-230 P[4] w/o glyco
MASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 222 - protein, 230 aa, Artificial Sequence
  VP8* aa2-230 P[6] w/o glyco
MASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 223 - protein, 230 aa, Artificial Sequence
  VP8* aa2-230 P[8] w/o glyco
MASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 224 - protein, 230 aa, Artificial Sequence
  VP8* aa2-230 P[8]-VirWa w/o glyco
MASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 225 - protein, 250 aa, Artificial Sequence
  VP8* aa2-230 P[4] P2+Linker w/o glyco
MQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 226 - protein, 250 aa, Artificial Sequence
  VP8* aa2-230 P[6] P2+Linker w/o glyco
MQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 227 - protein, 250 aa, Artificial Sequence
  VP8* aa2-230 P[8] P2+Linker w/o glyco
MQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 228 - protein, 250 aa, Artificial Sequence
  VP8* aa2-230 P[8]-VirWa P2+Linker w/o glyco
MQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 229 - protein, 250 aa, Artificial Sequence
  VP8* aa2-230 P[4] SP(TPA) w/o glyco
MDAMKRGLCCVLLLCGAVFVSASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 230 - protein, 250 aa, Artificial Sequence
  VP8* aa2-230 P[6] SP(TPA) w/o glyco
MDAMKRGLCCVLLLCGAVFVSASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 231 - protein, 250 aa, Artificial Sequence
  VP8* aa2-230 P[8] SP(TPA) w/o glyco
MDAMKRGLCCVLLLCGAVFVSASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 232 - protein, 250 aa, Artificial Sequence
  VP8* aa2-230 P[8]-VirWa SP(TPA) w/o glyco
MDAMKRGLCCVLLLCGAVFVSASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 233 - protein, 247 aa, Artificial Sequence
  VP8* aa2-230 P[4] SP(HSA) w/o glyco
MKWVTFISLLFLFSSAYSASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 234 - protein, 247 aa, Artificial Sequence
  VP8* aa2-230 P[6] SP(HSA) w/o glyco
MKWVTFISLLFLFSSAYSASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 235 - protein, 247 aa, Artificial Sequence
  VP8* aa2-230 P[8] SP(HSA) w/o glyco
MKWVTFISLLFLFSSAYSASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 236 - protein, 247 aa, Artificial Sequence
  VP8* aa2-230 P[8]-VirWa SP(HSA) w/o glyco
MKWVTFISLLFLFSSAYSASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 237 - protein, 247 aa, Artificial Sequence
  VP8* aa2-230 P[4] SP(IgE) w/o glyco
MDWTWILFLVAAATRVHSASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 238 - protein, 247 aa, Artificial Sequence
  VP8* aa2-230 P[6] SP(IgE) w/o glyco
MDWTWILFLVAAATRVHSASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 239 - protein, 247 aa, Artificial Sequence
  VP8* aa2-230 P[8] SP(IgE) w/o glyco
MDWTWILFLVAAATRVHSASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 240 - protein, 247 aa, Artificial Sequence
  VP8* aa2-230 P[8]-VirWa SP(IgE) w/o glyco
MDWTWILFLVAAATRVHSASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 241 - protein, 253 aa, Artificial Sequence
  VP8* aa2-230 P[4] SP(CD5) w/o glyco
MPMGSLQPLATLYLLGMLVASCLGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 242 - protein, 253 aa, Artificial Sequence
  VP8* aa2-230 P[6] SP(CD5) w/o glyco
MPMGSLQPLATLYLLGMLVASCLGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 243 - protein, 253 aa, Artificial Sequence
  VP8* aa2-230 P[8] SP(CD5) w/o glyco
MPMGSLQPLATLYLLGMLVASCLGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 244 - protein, 253 aa, Artificial Sequence
  VP8* aa2-230 P[8]-VirWa SP(CD5) w/o glyco
MPMGSLQPLATLYLLGMLVASCLGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 245 - protein, 253 aa, Artificial Sequence
  VP8* aa2-230 P[4] SP(HLA-A2) w/o glyco
MAVMAPRTLVLLLSGALALTQTWAASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 246 - protein, 253 aa, Artificial Sequence
  VP8* aa2-230 P[6] SP(HLA-A2) w/o glyco
MAVMAPRTLVLLLSGALALTQTWAASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 247 - protein, 253 aa, Artificial Sequence
  VP8* aa2-230 P[8] SP(HLA-A2) w/o glyco
MAVMAPRTLVLLLSGALALTQTWAASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 248 - protein, 253 aa, Artificial Sequence
  VP8* aa2-230 P[8]-VirWa SP(HLA-A2) w/o glyco
MAVMAPRTLVLLLSGALALTQTWAASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 249 - protein, 270 aa, Artificial Sequence
  VP8* aa2-230 P[4] SP(TPA)+P2+Linker w/o glyco
MDAMKRGLCCVLLLCGAVFVSQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 250 - protein, 270 aa, Artificial Sequence
  VP8* aa2-230 P[6] SP(TPA)+P2+Linker w/o glyco
MDAMKRGLCCVLLLCGAVFVSQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 251 - protein, 270 aa, Artificial Sequence
  VP8* aa2-230 P[8] SP(TPA)+P2+Linker w/o glyco
MDAMKRGLCCVLLLCGAVFVSQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 252 - protein, 270 aa, Artificial Sequence
  VP8* aa2-230 P[8]-VirWa SP(TPA)+P2+Linker w/o glyco
MDAMKRGLCCVLLLCGAVFVSQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 253 - protein, 267 aa, Artificial Sequence
  VP8* aa2-230 P[4] SP(HSA)+P2+Linker w/o glyco
MKWVTFISLLFLFSSAYSQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 254 - protein, 267 aa, Artificial Sequence
  VP8* aa2-230 P[6] SP(HSA)+P2+Linker w/o glyco
MKWVTFISLLFLFSSAYSQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 255 - protein, 267 aa, Artificial Sequence
  VP8* aa2-230 P[8] SP(HSA)+P2+Linker w/o glyco
MKWVTFISLLFLFSSAYSQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 256 - protein, 267 aa, Artificial Sequence
  VP8* aa2-230 P[8]-VirWa SP(HSA)+P2+Linker w/o glyco
MKWVTFISLLFLFSSAYSQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 257 - protein, 267 aa, Artificial Sequence
  VP8* aa2-230 P[4] SP(IgE)+P2+Linker w/o glyco
MDWTWILFLVAAATRVHSQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 258 - protein, 267 aa, Artificial Sequence
  VP8* aa2-230 P[6] SP(IgE)+P2+Linker w/o glyco
MDWTWILFLVAAATRVHSQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 259 - protein, 267 aa, Artificial Sequence
  VP8* aa2-230 P[8] SP(IgE)+P2+Linker w/o glyco
MDWTWILFLVAAATRVHSQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 260 - protein, 267 aa, Artificial Sequence
  VP8* aa2-230 P[8]-VirWa SP(IgE)+P2+Linker w/o glyco
MDWTWILFLVAAATRVHSQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 261 - protein, 273 aa, Artificial Sequence
  VP8* aa2-230 P[4] SP(CD5)+P2+Linker w/o glyco
MPMGSLQPLATLYLLGMLVASCLGQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 262 - protein, 273 aa, Artificial Sequence
  VP8* aa2-230 P[6] SP(CD5)+P2+Linker w/o glyco
MPMGSLQPLATLYLLGMLVASCLGQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 263 - protein, 273 aa, Artificial Sequence
  VP8* aa2-230 P[8] SP(CD5)+P2+Linker w/o glyco
MPMGSLQPLATLYLLGMLVASCLGQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 264 - protein, 273 aa, Artificial Sequence
  VP8* aa2-230 P[8]-VirWa SP(CD5)+P2+Linker w/o glyco
MPMGSLQPLATLYLLGMLVASCLGQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 265 - protein, 273 aa, Artificial Sequence
  VP8* aa2-230 P[4] SP(HLA-A2)+P2+Linker w/o glyco
MAVMAPRTLVLLLSGALALTQTWAQYIKANSKFIGITELGSGSGASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTR

SEQ ID NO: 266 - protein, 273 aa, Artificial Sequence
  VP8* aa2-230 P[6] SP(HLA-A2)+P2+Linker w/o glyco
MAVMAPRTLVLLLSGALALTQTWAQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTR

SEQ ID NO: 267 - protein, 273 aa, Artificial Sequence
  VP8* aa2-230 P[8] SP(HLA-A2)+P2+Linker w/o glyco
MAVMAPRTLVLLLSGALALTQTWAQYIKANSKFIGITELGSGSGASLIYRQLLTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTR

SEQ ID NO: 268 - protein, 273 aa, Artificial Sequence
  VP8* aa2-230 P[8]-VirWa SP(HLA-A2)+P2+Linker w/o glyco
MAVMAPRTLVLLLSGALALTQTWAQYIKANSKFIGITELGSGSGASLIYRQLLTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTR

SEQ ID NO: 269 - protein, 214 aa, Artificial Sequence
  VP8* aa11-223 P[4]
MTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 270 - protein, 214 aa, Artificial Sequence
  VP8* aa11-223 P[6]
MTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 271 - protein, 214 aa, Artificial Sequence
  VP8* aa11-223 P[8]
MTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 272 - protein, 214 aa, Artificial Sequence
  VP8* aa11-223 P[8]-VirWa
MTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 273 - protein, 234 aa, Artificial Sequence
  VP8* aa11-223 P[4] P2+Linker
MQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 274 - protein, 234 aa, Artificial Sequence
  VP8* aa11-223 P[6] P2+Linker
MQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 275 - protein, 234 aa, Artificial Sequence
  VP8* aa11-223 P[8] P2+Linker
MQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 276 - protein, 234 aa, Artificial Sequence
  VP8* aa11-223 P[8]-VirWa P2+Linker
MQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 277 - protein, 234 aa, Artificial Sequence
  VP8* aa11-223 P[4] SP(TPA)
MDAMKRGLCCVLLLCGAVFVSTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 278 - protein, 234 aa, Artificial Sequence
  VP8* aa11-223 P[6] SP(TPA)
MDAMKRGLCCVLLLCGAVFVSTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 279 - protein, 234 aa, Artificial Sequence
  VP8* aa11-223 P[8] SP(TPA)
MDAMKRGLCCVLLLCGAVFVSTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 280 - protein, 234 aa, Artificial Sequence
  VP8* aa11-223 P[8]-VirWa SP(TPA)
MDAMKRGLCCVLLLCGAVFVSTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 281 - protein, 231 aa, Artificial Sequence
  VP8* aa11-223 P[4] SP(HSA)
MKWVTFISLLFLFSSAYSTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 282 - protein, 231 aa, Artificial Sequence
  VP8* aa11-223 P[6] SP(HSA)
MKWVTFISLLFLFSSAYSTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 283 - protein, 231 aa, Artificial Sequence
  VP8* aa11-223 P[8] SP(HSA)
MKWVTFISLLFLFSSAYSTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 284 - protein, 231 aa, Artificial Sequence
  VP8* aa11-223 P[8]-VirWa SP(HSA)
MKWVTFISLLFLFSSAYSTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 285 - protein, 231 aa, Artificial Sequence
  VP8* aa11-223 P[4] SP(IgE)
MDWTWILFLVAAATRVHSTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 286 - protein, 231 aa, Artificial Sequence
  VP8* aa11-223 P[6] SP(IgE)
MDWTWILFLVAAATRVHSTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 287 - protein, 231 aa, Artificial Sequence
  VP8* aa11-223 P[8] SP(IgE)
MDWTWILFLVAAATRVHSTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 288 - protein, 231 aa, Artificial Sequence
  VP8* aa11-223 P[8]-VirWa SP(IgE)
MDWTWILFLVAAATRVHSTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 289 - protein, 237 aa, Artificial Sequence
  VP8* aa11-223 P[4] SP(CD5)
MPMGSLQPLATLYLLGMLVASCLGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 290 - protein, 237 aa, Artificial Sequence
  VP8* aa11-223 P[6] SP(CD5)
MPMGSLQPLATLYLLGMLVASCLGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 291 - protein, 237 aa, Artificial Sequence
  VP8* aa11-223 P[8] SP(CD5)
MPMGSLQPLATLYLLGMLVASCLGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 292 - protein, 237 aa, Artificial Sequence
  VP8* aa11-223 P[8]-VirWa SP(CD5)
MPMGSLQPLATLYLLGMLVASCLGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 293 - protein, 237 aa, Artificial Sequence
  VP8* aa11-223 P[4] SP(HLA-A2)
MAVMAPRTLVLLLSGALALTQTWATNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 294 - protein, 237 aa, Artificial Sequence
  VP8* aa11-223 P[6] SP(HLA-A2)
MAVMAPRTLVLLLSGALALTQTWATNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 295 - protein, 237 aa, Artificial Sequence
  VP8* aa11-223 P[8] SP(HLA-A2)
MAVMAPRTLVLLLSGALALTQTWATNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 296 - protein, 237 aa, Artificial Sequence
  VP8* aa11-223 P[8]-VirWa SP(HLA-A2)
MAVMAPRTLVLLLSGALALTQTWATNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 297 - protein, 254 aa, Artificial Sequence
  VP8* aa11-223 P[4] SP(TPA)+P2+Linker
MDAMKRGLCCVLLLCGAVFVSQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 298 - protein, 254 aa, Artificial Sequence
  VP8* aa11-223 P[6] SP(TPA)+P2+Linker
MDAMKRGLCCVLLLCGAVFVSQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 299 - protein, 254 aa, Artificial Sequence
  VP8* aa11-223 P[8] SP(TPA)+P2+Linker
MDAMKRGLCCVLLLCGAVFVSQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 300 - protein, 254 aa, Artificial Sequence
  VP8* aa11-223 P[8]-VirWa SP(TPA)+P2+Linker
MDAMKRGLCCVLLLCGAVFVSQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 301 - protein, 251 aa, Artificial Sequence
  VP8* aa11-223 P[4] SP(HSA)+P2+Linker
MKWVTFISLLFLFSSAYSQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 302 - protein, 251 aa, Artificial Sequence
  VP8* aa11-223 P[6] SP(HSA)+P2+Linker
MKWVTFISLLFLFSSAYSQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 303 - protein, 251 aa, Artificial Sequence
  VP8* aa11-223 P[8] SP(HSA)+P2+Linker
MKWVTFISLLFLFSSAYSQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 304 - protein, 251 aa, Artificial Sequence
  VP8* aa11-223 P[8]-VirWa SP(HSA)+P2+Linker
MKWVTFISLLFLFSSAYSQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 305 - protein, 251 aa, Artificial Sequence
  VP8* aa11-223 P[4] SP(IgE)+P2+Linker
MDWTWILFLVAAATRVHSQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 306 - protein, 251 aa, Artificial Sequence
  VP8* aa11-223 P[6] SP(IgE)+P2+Linker
MDWTWILFLVAAATRVHSQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 307 - protein, 251 aa, Artificial Sequence
  VP8* aa11-223 P[8] SP(IgE)+P2+Linker
MDWTWILFLVAAATRVHSQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 308 - protein, 251 aa, Artificial Sequence
  VP8* aa11-223 P[8]-VirWa SP(IgE)+P2+Linker
MDWTWILFLVAAATRVHSQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 309 - protein, 257 aa, Artificial Sequence
  VP8* aa11-223 P[4] SP(CD5)+P2+Linker
MPMGSLQPLATLYLLGMLVASCLGQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 310 - protein, 257 aa, Artificial Sequence
  VP8* aa11-223 P[6] SP(CD5)+P2+Linker
MPMGSLQPLATLYLLGMLVASCLGQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 311 - protein, 257 aa, Artificial Sequence
  VP8* aa11-223 P[8] SP(CD5)+P2+Linker
MPMGSLQPLATLYLLGMLVASCLGQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 312 - protein, 257 aa, Artificial Sequence
  VP8* aa11-223 P[8]-VirWa SP(CD5)+P2+Linker
MPMGSLQPLATLYLLGMLVASCLGQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 313 - protein, 257 aa, Artificial Sequence
  VP8* aa11-223 P[4] SP(HLA-A2)+P2+Linker
MAVMAPRTLVLLLSGALALTQTWAQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 314 - protein, 257 aa, Artificial Sequence
  VP8* aa11-223 P[6] SP(HLA-A2)+P2+Linker
MAVMAPRTLVLLLSGALALTQTWAQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 315 - protein, 257 aa, Artificial Sequence
  VP8* aa11-223 P[8] SP(HLA-A2)+P2+Linker
MAVMAPRTLVLLLSGALALTQTWAQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 316 - protein, 257 aa, Artificial Sequence
  VP8* aa11-223 P[8]-VirWa SP(HLA-A2)+P2+Linker
MAVMAPRTLVLLLSGALALTQTWAQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 317 - protein, 214 aa, Artificial Sequence
  VP8* aa11-223 P[4] w/o glyco
MTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 318 - protein, 214 aa, Artificial Sequence
  VP8* aa11-223 P[6] w/o glyco
MTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 319 - protein, 214 aa, Artificial Sequence
  VP8* aa11-223 P[8] w/o glyco
MTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 320 - protein, 214 aa, Artificial Sequence
  VP8* aa11-223 P[8]-VirWa w/o glyco
MTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 321 - protein, 234 aa, Artificial Sequence
  VP8* aa11-223 P[4] P2+Linker w/o glyco
MQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 322 - protein, 234 aa, Artificial Sequence
  VP8* aa11-223 P[6] P2+Linker w/o glyco
MQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 323 - protein, 234 aa, Artificial Sequence
  VP8* aa11-223 P[8] P2+Linker w/o glyco
MQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 324 - protein, 234 aa, Artificial Sequence
  VP8* aa11-223 P[8]-VirWa P2+Linker w/o glyco
MQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 325 - protein, 234 aa, Artificial Sequence
  VP8* aa11-223 P[4] SP(TPA) w/o glyco
MDAMKRGLCCVLLLCGAVFVSTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 326 - protein, 234 aa, Artificial Sequence
  VP8* aa11-223 P[6] SP(TPA) w/o glyco
MDAMKRGLCCVLLLCGAVFVSTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 327 - protein, 234 aa, Artificial Sequence
  VP8* aa11-223 P[8] SP(TPA) w/o glyco
MDAMKRGLCCVLLLCGAVFVSTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 328 - protein, 234 aa, Artificial Sequence
  VP8* aa11-223 P[8]-VirWa SP(TPA) w/o glyco
MDAMKRGLCCVLLLCGAVFVSTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 329 - protein, 231 aa, Artificial Sequence
  VP8* aa11-223 P[4] SP(HSA) w/o glyco
MKWVTFISLLFLFSSAYSTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 330 - protein, 231 aa, Artificial Sequence
  VP8* aa11-223 P[6] SP(HSA) w/o glyco
MKWVTFISLLFLFSSAYSTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 331 - protein, 231 aa, Artificial Sequence
  VP8* aa11-223 P[8] SP(HSA) w/o glyco
MKWVTFISLLFLFSSAYSTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 332 - protein, 231 aa, Artificial Sequence
  VP8* aa11-223 P[8]-VirWa SP(HSA) w/o glyco
MKWVTFISLLFLFSSAYSTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 333 - protein, 231 aa, Artificial Sequence
  VP8* aa11-223 P[4] SP(IgE) w/o glyco
MDWTWILFLVAAATRVHSTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 334 - protein, 231 aa, Artificial Sequence
  VP8* aa11-223 P[6] SP(IgE) w/o glyco
MDWTWILFLVAAATRVHSTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 335 - protein, 231 aa, Artificial Sequence
  VP8* aa11-223 P[8] SP(IgE) w/o glyco
MDWTWILFLVAAATRVHSTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 336 - protein, 231 aa, Artificial Sequence
  VP8* aa11-223 P[8]-VirWa SP(IgE) w/o glyco
MDWTWILFLVAAATRVHSTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 337 - protein, 237 aa, Artificial Sequence
  VP8* aa11-223 P[4] SP(CD5) w/o glyco
MPMGSLQPLATLYLLGMLVASCLGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 338 - protein, 237 aa, Artificial Sequence
  VP8* aa11-223 P[6] SP(CD5) w/o glyco
MPMGSLQPLATLYLLGMLVASCLGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 339 - protein, 237 aa, Artificial Sequence
  VP8* aa11-223 P[8] SP(CD5) w/o glyco
MPMGSLQPLATLYLLGMLVASCLGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 340 - protein, 237 aa, Artificial Sequence
  VP8* aa11-223 P[8]-VirWa SP(CD5) w/o glyco
MPMGSLQPLATLYLLGMLVASCLGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 341 - protein, 237 aa, Artificial Sequence
  VP8* aa11-223 P[4] SP(HLA-A2) w/o glyco
MAVMAPRTLVLLLSGALALTQTWATNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 342 - protein, 237 aa, Artificial Sequence
  VP8* aa11-223 P[6] SP(HLA-A2) w/o glyco
MAVMAPRTLVLLLSGALALTQTWATNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 343 - protein, 237 aa, Artificial Sequence
  VP8* aa11-223 P[8] SP(HLA-A2) w/o glyco
MAVMAPRTLVLLLSGALALTQTWATNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 344 - protein, 237 aa, Artificial Sequence
  VP8* aa11-223 P[8]-VirWa SP(HLA-A2) w/o glyco
MAVMAPRTLVLLLSGALALTQTWATNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 345 - protein, 254 aa, Artificial Sequence
  VP8* aa11-223 P[4] SP(TPA)+P2+Linker w/o glyco
MDAMKRGLCCVLLLCGAVFVSQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 346 - protein, 254 aa, Artificial Sequence
  VP8* aa11-223 P[6] SP(TPA)+P2+Linker w/o glyco
MDAMKRGLCCVLLLCGAVFVSQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 347 - protein, 254 aa, Artificial Sequence
  VP8* aa11-223 P[8] SP(TPA)+P2+Linker w/o glyco
MDAMKRGLCCVLLLCGAVFVSQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 348 - protein, 254 aa, Artificial Sequence
  VP8* aa11-223 P[8]-VirWa SP(TPA)+P2+Linker w/o glyco
MDAMKRGLCCVLLLCGAVFVSQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 349 - protein, 251 aa, Artificial Sequence
  VP8* aa11-223 P[4] SP(HSA)+P2+Linker w/o glyco
MKWVTFISLLFLFSSAYSQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 350 - protein, 251 aa, Artificial Sequence
  VP8* aa11-223 P[6] SP(HSA)+P2+Linker w/o glyco
MKWVTFISLLFLFSSAYSQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 351 - protein, 251 aa, Artificial Sequence
  VP8* aa11-223 P[8] SP(HSA)+P2+Linker w/o glyco
MKWVTFISLLFLFSSAYSQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 352 - protein, 251 aa, Artificial Sequence
  VP8* aa11-223 P[8]-VirWa SP(HSA)+P2+Linker w/o glyco
MKWVTFISLLFLFSSAYSQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 353 - protein, 251 aa, Artificial Sequence
  VP8* aa11-223 P[4] SP(IgE)+P2+Linker w/o glyco
MDWTWILFLVAAATRVHSQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 354 - protein, 251 aa, Artificial Sequence
  VP8* aa11-223 P[6] SP(IgE)+P2+Linker w/o glyco
MDWTWILFLVAAATRVHSQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 355 - protein, 251 aa, Artificial Sequence
  VP8* aa11-223 P[8] SP(IgE)+P2+Linker w/o glyco
MDWTWILFLVAAATRVHSQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 356 - protein, 251 aa, Artificial Sequence
  VP8* aa11-223 P[8]-VirWa SP(IgE)+P2+Linker w/o glyco
MDWTWILFLVAAATRVHSQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 357 - protein, 257 aa, Artificial Sequence
  VP8* aa11-223 P[4] SP(CD5)+P2+Linker w/o glyco
MPMGSLQPLATLYLLGMLVASCLGQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 358 - protein, 257 aa, Artificial Sequence
  VP8* aa11-223 P[6] SP(CD5)+P2+Linker w/o glyco
MPMGSLQPLATLYLLGMLVASCLGQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 359 - protein, 257 aa, Artificial Sequence
  VP8* aa11-223 P[8] SP(CD5)+P2+Linker w/o glyco
MPMGSLQPLATLYLLGMLVASCLGQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 360 - protein, 257 aa, Artificial Sequence
  VP8* aa11-223 P[8]-VirWa SP(CD5)+P2+Linker w/o glyco
MPMGSLQPLATLYLLGMLVASCLGQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 361 - protein, 257 aa, Artificial Sequence
  VP8* aa11-223 P[4] SP(HLA-A2)+P2+Linker w/o glyco
MAVMAPRTLVLLLSGALALTQTWAQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 362 - protein, 257 aa, Artificial Sequence
  VP8* aa11-223 P[6] SP(HLA-A2)+P2+Linker w/o glyco
MAVMAPRTLVLLLSGALALTQTWAQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 363 - protein, 257 aa, Artificial Sequence
  VP8* aa11-223 P[8] SP(HLA-A2)+P2+Linker w/o glyco
MAVMAPRTLVLLLSGALALTQTWAQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 364 - protein, 257 aa, Artificial Sequence
  VP8* aa11-223 P[8]-VirWa SP(HLA-A2)+P2+Linker w/o glyco
MAVMAPRTLVLLLSGALALTQTWAQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 365 - protein, 231 aa, Artificial Sequence
  VP8* aa11-240 P[4]
MTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 366 - protein, 231 aa, Artificial Sequence
  VP8* aa11-240 P[6]
MTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 367 - protein, 231 aa, Artificial Sequence
  VP8* aa11-240 P[8]
MTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 368 - protein, 231 aa, Artificial Sequence
  VP8* aa11-240 P[8]-VirWa
MTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 369 - protein, 251 aa, Artificial Sequence
  VP8* aa11-240 P[4] P2+Linker
MQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 370 - protein, 251 aa, Artificial Sequence
  VP8* aa11-240 P[6] P2+Linker
MQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 371 - protein, 251 aa, Artificial Sequence
  VP8* aa11-240 P[8] P2+Linker
MQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 372 - protein, 251 aa, Artificial Sequence
  VP8* aa11-240 P[8]-VirWa P2+Linker
MQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 373 - protein, 251 aa, Artificial Sequence
  VP8* aa11-240 P[4] SP(TPA)
MDAMKRGLCCVLLLCGAVFVSTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 374 - protein, 251 aa, Artificial Sequence
  VP8* aa11-240 P[6] SP(TPA)
MDAMKRGLCCVLLLCGAVFVSTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 375 - protein, 251 aa, Artificial Sequence
  VP8* aa11-240 P[8] SP(TPA)
MDAMKRGLCCVLLLCGAVFVSTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 376 - protein, 251 aa, Artificial Sequence
  VP8* aa11-240 P[8]-VirWa SP(TPA)
MDAMKRGLCCVLLLCGAVFVSTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 377 - protein, 248 aa, Artificial Sequence
  VP8* aa11-240 P[4] SP(HSA)
MKWVTFISLLFLFSSAYSTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 378 - protein, 248 aa, Artificial Sequence
  VP8* aa11-240 P[6] SP(HSA)
MKWVTFISLLFLFSSAYSTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 379 - protein, 248 aa, Artificial Sequence
  VP8* aa11-240 P[8] SP(HSA)
MKWVTFISLLFLFSSAYSTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 380 - protein, 248 aa, Artificial Sequence
  VP8* aa11-240 P[8]-VirWa SP(HSA)
MKWVTFISLLFLFSSAYSTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 381 - protein, 248 aa, Artificial Sequence
  VP8* aa11-240 P[4] SP(IgE)
MDWTWILFLVAAATRVHSTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 382 - protein, 248 aa, Artificial Sequence
  VP8* aa11-240 P[6] SP(IgE)
MDWTWILFLVAAATRVHSTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 383 - protein, 248 aa, Artificial Sequence
  VP8* aa11-240 P[8] SP(IgE)
MDWTWILFLVAAATRVHSTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 384 - protein, 248 aa, Artificial Sequence
  VP8* aa11-240 P[8]-VirWa SP(IgE)
MDWTWILFLVAAATRVHSTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 385 - protein, 254 aa, Artificial Sequence
  VP8* aa11-240 P[4] SP(CD5)
MPMGSLQPLATLYLLGMLVASCLGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 386 - protein, 254 aa, Artificial Sequence
  VP8* aa11-240 P[6] SP(CD5)
MPMGSLQPLATLYLLGMLVASCLGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 387 - protein, 254 aa, Artificial Sequence
  VP8* aa11-240 P[8] SP(CD5)
MPMGSLQPLATLYLLGMLVASCLGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 388 - protein, 254 aa, Artificial Sequence
  VP8* aa11-240 P[8]-VirWa SP(CD5)
MPMGSLQPLATLYLLGMLVASCLGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 389 - protein, 254 aa, Artificial Sequence
  VP8* aa11-240 P[4] SP(HLA-A2)
MAVMAPRTLVLLLSGALALTQTWATNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 390 - protein, 254 aa, Artificial Sequence
  VP8* aa11-240 P[6] SP(HLA-A2)
MAVMAPRTLVLLLSGALALTQTWATNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 391 - protein, 254 aa, Artificial Sequence
  VP8* aa11-240 P[8] SP(HLA-A2)
MAVMAPRTLVLLLSGALALTQTWATNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 392 - protein, 254 aa, Artificial Sequence
  VP8* aa11-240 P[8]-VirWa SP(HLA-A2)
MAVMAPRTLVLLLSGALALTQTWATNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 393 - protein, 271 aa, Artificial Sequence
  VP8* aa11-240 P[4] SP(TPA)+P2+Linker
MDAMKRGLCCVLLLCGAVFVSQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 394 - protein, 271 aa, Artificial Sequence
  VP8* aa11-240 P[6] SP(TPA)+P2+Linker
MDAMKRGLCCVLLLCGAVFVSQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 395 - protein, 271 aa, Artificial Sequence
  VP8* aa11-240 P[8] SP(TPA)+P2+Linker
MDAMKRGLCCVLLLCGAVFVSQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 396 - protein, 271 aa, Artificial Sequence
  VP8* aa11-240 P[8]-VirWa SP(TPA)+P2+Linker
MDAMKRGLCCVLLLCGAVFVSQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 397 - protein, 268 aa, Artificial Sequence
  VP8* aa11-240 P[4] SP(HSA)+P2+Linker
MKWVTFISLLFLFSSAYSQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 398 - protein, 268 aa, Artificial Sequence
  VP8* aa11-240 P[6] SP(HSA)+P2+Linker
MKWVTFISLLFLFSSAYSQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 399 - protein, 268 aa, Artificial Sequence
  VP8* aa11-240 P[8] SP(HSA)+P2+Linker
MKWVTFISLLFLFSSAYSQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 400 - protein, 268 aa, Artificial Sequence
  VP8* aa11-240 P[8]-VirWa SP(HSA)+P2+Linker
MKWVTFISLLFLFSSAYSQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 401 - protein, 268 aa, Artificial Sequence
  VP8* aa11-240 P[4] SP(IgE)+P2+Linker
MDWTWILFLVAAATRVHSQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 402 - protein, 268 aa, Artificial Sequence
  VP8* aa11-240 P[6] SP(IgE)+P2+Linker
MDWTWILFLVAAATRVHSQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 403 - protein, 268 aa, Artificial Sequence
  VP8* aa11-240 P[8] SP(IgE)+P2+Linker
MDWTWILFLVAAATRVHSQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 404 - protein, 268 aa, Artificial Sequence
  VP8* aa11-240 P[8]-VirWa SP(IgE)+P2+Linker
MDWTWILFLVAAATRVHSQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 405 - protein, 274 aa, Artificial Sequence
  VP8* aa11-240 P[4] SP(CD5)+P2+Linker
MPMGSLQPLATLYLLGMLVASCLGQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 406 - protein, 274 aa, Artificial Sequence
  VP8* aa11-240 P[6] SP(CD5)+P2+Linker
MPMGSLQPLATLYLLGMLVASCLGQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 407 - protein, 274 aa, Artificial Sequence
  VP8* aa11-240 P[8] SP(CD5)+P2+Linker
MPMGSLQPLATLYLLGMLVASCLGQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 408 - protein, 274 aa, Artificial Sequence
  VP8* aa11-240 P[8]-VirWa SP(CD5)+P2+Linker
MPMGSLQPLATLYLLGMLVASCLGQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 409 - protein, 274 aa, Artificial Sequence
  VP8* aa11-240 P[4] SP(HLA-A2)+P2+Linker
MAVMAPRTLVLLLSGALALTQTWAQYIKANSKFIGITELGSGSGTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 410 - protein, 274 aa, Artificial Sequence
  VP8* aa11-240 P[6] SP(HLA-A2)+P2+Linker
MAVMAPRTLVLLLSGALALTQTWAQYIKANSKFIGITELGSGSGTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 411 - protein, 274 aa, Artificial Sequence
  VP8* aa11-240 P[8] SP(HLA-A2)+P2+Linker
MAVMAPRTLVLLLSGALALTQTWAQYIKANSKFIGITELGSGSGTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 412 - protein, 274 aa, Artificial Sequence
  VP8* aa11-240 P[8]-VirWa SP(HLA-A2)+P2+Linker
MAVMAPRTLVLLLSGALALTQTWAQYIKANSKFIGITELGSGSGTNSYSVDLHDEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 413 - protein, 231 aa, Artificial Sequence
  VP8* aa11-240 P[4] w/o glyco
MTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 414 - protein, 231 aa, Artificial Sequence
  VP8* aa11-240 P[6] w/o glyco
MTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 415 - protein, 231 aa, Artificial Sequence
  VP8* aa11-240 P[8] w/o glyco
MTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 416 - protein, 231 aa, Artificial Sequence
  VP8* aa11-240 P[8]-VirWa w/o glyco
MTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 417 - protein, 251 aa, Artificial Sequence
  VP8* aa11-240 P[4] P2+Linker w/o glyco
MQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 418 - protein, 251 aa, Artificial Sequence
  VP8* aa11-240 P[6] P2+Linker w/o glyco
MQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 419 - protein, 251 aa, Artificial Sequence
  VP8* aa11-240 P[8] P2+Linker w/o glyco
MQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 420 - protein, 251 aa, Artificial Sequence
  VP8* aa11-240 P[8]-VirWa P2+Linker w/o glyco
MQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 421 - protein, 251 aa, Artificial Sequence
  VP8* aa11-240 P[4] SP(TPA) w/o glyco
MDAMKRGLCCVLLLCGAVFVSTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 422 - protein, 251 aa, Artificial Sequence
  VP8* aa11-240 P[6] SP(TPA) w/o glyco
MDAMKRGLCCVLLLCGAVFVSTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 423 - protein, 251 aa, Artificial Sequence
  VP8* aa11-240 P[8] SP(TPA) w/o glyco
MDAMKRGLCCVLLLCGAVFVSTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 424 - protein, 251 aa, Artificial Sequence
  VP8* aa11-240 P[8]-VirWa SP(TPA) w/o glyco
MDAMKRGLCCVLLLCGAVFVSTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 425 - protein, 248 aa, Artificial Sequence
  VP8* aa11-240 P[4] SP(HSA) w/o glyco
MKWVTFISLLFLFSSAYSTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 426 - protein, 248 aa, Artificial Sequence
  VP8* aa11-240 P[6] SP(HSA) w/o glyco
MKWVTFISLLFLFSSAYSTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 427 - protein, 248 aa, Artificial Sequence
  VP8* aa11-240 P[8] SP(HSA) w/o glyco
MKWVTFISLLFLFSSAYSTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 428 - protein, 248 aa, Artificial Sequence
  VP8* aa11-240 P[8]-VirWa SP(HSA) w/o glyco
MKWVTFISLLFLFSSAYSTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 429 - protein, 248 aa, Artificial Sequence
  VP8* aa11-240 P[4] SP(IgE) w/o glyco
MDWTWILFLVAAATRVHSTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 430 - protein, 248 aa, Artificial Sequence
  VP8* aa11-240 P[6] SP(IgE) w/o glyco
MDWTWILFLVAAATRVHSTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 431 - protein, 248 aa, Artificial Sequence
  VP8* aa11-240 P[8] SP(IgE) w/o glyco
MDWTWILFLVAAATRVHSTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 432 - protein, 248 aa, Artificial Sequence
  VP8* aa11-240 P[8]-VirWa SP(IgE) w/o glyco
MDWTWILFLVAAATRVHSTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 433 - protein, 254 aa, Artificial Sequence
  VP8* aa11-240 P[4] SP(CD5) w/o glyco
MPMGSLQPLATLYLLGMLVASCLGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 434 - protein, 254 aa, Artificial Sequence
  VP8* aa11-240 P[6] SP(CD5) w/o glyco
MPMGSLQPLATLYLLGMLVASCLGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 435 - protein, 254 aa, Artificial Sequence
  VP8* aa11-240 P[8] SP(CD5) w/o glyco
MPMGSLQPLATLYLLGMLVASCLGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 436 - protein, 254 aa, Artificial Sequence
  VP8* aa11-240 P[8]-VirWa SP(CD5) w/o glyco
MPMGSLQPLATLYLLGMLVASCLGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 437 - protein, 254 aa, Artificial Sequence
  VP8* aa11-240 P[4] SP(HLA-A2) w/o glyco
MAVMAPRTLVLLLSGALALTQTWATNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 438 - protein, 254 aa, Artificial Sequence
  VP8* aa11-240 P[6] SP(HLA-A2) w/o glyco
MAVMAPRTLVLLLSGALALTQTWATNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 439 - protein, 254 aa, Artificial Sequence
  VP8* aa11-240 P[8] SP(HLA-A2) w/o glyco
MAVMAPRTLVLLLSGALALTQTWATNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 440 - protein, 254 aa, Artificial Sequence
  VP8* aa11-240 P[8]-VirWa SP(HLA-A2) w/o glyco
MAVMAPRTLVLLLSGALALTQTWATNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 441 - protein, 271 aa, Artificial Sequence
  VP8* aa11-240 P[4] SP(TPA)+P2+Linker w/o glyco
MDAMKRGLCCVLLLCGAVFVSQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 442 - protein, 271 aa, Artificial Sequence
  VP8* aa11-240 P[6] SP(TPA)+P2+Linker w/o glyco
MDAMKRGLCCVLLLCGAVFVSQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 443 - protein, 271 aa, Artificial Sequence
  VP8* aa11-240 P[8] SP(TPA)+P2+Linker w/o glyco
MDAMKRGLCCVLLLCGAVFVSQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 444 - protein, 271 aa, Artificial Sequence
  VP8* aa11-240 P[8]-VirWa SP(TPA)+P2+Linker w/o glyco
MDAMKRGLCCVLLLCGAVFVSQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 445 - protein, 268 aa, Artificial Sequence
  VP8* aa11-240 P[4] SP(HSA)+P2+Linker w/o glyco
MKWVTFISLLFLFSSAYSQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 446 - protein, 268 aa, Artificial Sequence
  VP8* aa11-240 P[6] SP(HSA)+P2+Linker w/o glyco
MKWVTFISLLFLFSSAYSQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 447 - protein, 268 aa, Artificial Sequence
  VP8* aa11-240 P[8] SP(HSA)+P2+Linker w/o glyco
MKWVTFISLLFLFSSAYSQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 448 - protein, 268 aa, Artificial Sequence
  VP8* aa11-240 P[8]-VirWa SP(HSA)+P2+Linker w/o glyco
MKWVTFISLLFLFSSAYSQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 449 - protein, 268 aa, Artificial Sequence
  VP8* aa11-240 P[4] SP(IgE)+P2+Linker w/o glyco
MDWTWILFLVAAATRVHSQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 450 - protein, 268 aa, Artificial Sequence
  VP8* aa11-240 P[6] SP(IgE)+P2+Linker w/o glyco
MDWTWILFLVAAATRVHSQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 451 - protein, 268 aa, Artificial Sequence
  VP8* aa11-240 P[8] SP(IgE)+P2+Linker w/o glyco
MDWTWILFLVAAATRVHSQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 452 - protein, 268 aa, Artificial Sequence
  VP8* aa11-240 P[8]-VirWa SP(IgE)+P2+Linker w/o glyco
MDWTWILFLVAAATRVHSQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 453 - protein, 274 aa, Artificial Sequence
  VP8* aa11-240 P[4] SP(CD5)+P2+Linker w/o glyco
MPMGSLQPLATLYLLGMLVASCLGQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 454 - protein, 274 aa, Artificial Sequence
  VP8* aa11-240 P[6] SP(CD5)+P2+Linker w/o glyco
MPMGSLQPLATLYLLGMLVASCLGQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 455 - protein, 274 aa, Artificial Sequence
  VP8* aa11-240 P[8] SP(CD5)+P2+Linker w/o glyco
MPMGSLQPLATLYLLGMLVASCLGQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 456 - protein, 274 aa, Artificial Sequence
  VP8* aa11-240 P[8]-VirWa SP(CD5)+P2+Linker w/o glyco
MPMGSLQPLATLYLLGMLVASCLGQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 457 - protein, 274 aa, Artificial Sequence
  VP8* aa11-240 P[4] SP(HLA-A2)+P2+Linker w/o glyco
MAVMAPRTLVLLLSGALALTQTWAQYIKANSKFIGITELGSGSGTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 458 - protein, 274 aa, Artificial Sequence
  VP8* aa11-240 P[6] SP(HLA-A2)+P2+Linker w/o glyco
MAVMAPRTLVLLLSGALALTQTWAQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 459 - protein, 274 aa, Artificial Sequence
  VP8* aa11-240 P[8] SP(HLA-A2)+P2+Linker w/o glyco
MAVMAPRTLVLLLSGALALTQTWAQYIKANSKFIGITELGSGSGTNSYSVDLHDEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 460 - protein, 274 aa, Artificial Sequence
  VP8* aa11-240 P[8]-VirWa SP(HLA-A2)+P2+Linker w/o glyco
MAVMAPRTLVLLLSGALALTQTWAQYIKANSKFIGITELGSGSGTNSYSVDLHDEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 461 - protein, 221 aa, Artificial Sequence
  VP8* aa21-240 P[4]
MEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 462 - protein, 221 aa, Artificial Sequence
  VP8* aa21-240 P[6]
MEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 463 - protein, 221 aa, Artificial Sequence
  VP8* aa21-240 P[8]
MEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 464 - protein, 221 aa, Artificial Sequence
  VP8* aa21-240 P[8]-VirWa
MEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 465 - protein, 241 aa, Artificial Sequence
  VP8* aa21-240 P[4] P2+Linker
MQYIKANSKFIGITELGSGSGEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 466 - protein, 241 aa, Artificial Sequence
  VP8* aa21-240 P[6] P2+Linker
MQYIKANSKFIGITELGSGSGEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 467 - protein, 241 aa, Artificial Sequence
  VP8* aa21-240 P[8] P2+Linker
MQYIKANSKFIGITELGSGSGEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 468 - protein, 241 aa, Artificial Sequence
  VP8* aa21-240 P[8]-VirWa P2+Linker
MQYIKANSKFIGITELGSGSGEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 469 - protein, 241 aa, Artificial Sequence
  VP8* aa21-240 P[4] SP(TPA)
MDAMKRGLCCVLLLCGAVFVSEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 470 - protein, 241 aa, Artificial Sequence
  VP8* aa21-240 P[6] SP(TPA)
MDAMKRGLCCVLLLCGAVFVSEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 471 - protein, 241 aa, Artificial Sequence
  VP8* aa21-240 P[8] SP(TPA)
MDAMKRGLCCVLLLCGAVFVSEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 472 - protein, 241 aa, Artificial Sequence
  VP8* aa21-240 P[8]-VirWa SP(TPA)
MDAMKRGLCCVLLLCGAVFVSEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 473 - protein, 238 aa, Artificial Sequence
  VP8* aa21-240 P[4] SP(HSA)
MKWVTFISLLFLFSSAYSEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 474 - protein, 238 aa, Artificial Sequence
  VP8* aa21-240 P[6] SP(HSA)
MKWVTFISLLFLFSSAYSEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 475 - protein, 238 aa, Artificial Sequence
  VP8* aa21-240 P[8] SP(HSA)
MKWVTFISLLFLFSSAYSEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 476 - protein, 238 aa, Artificial Sequence
  VP8* aa21-240 P[8]-VirWa SP(HSA)
MKWVTFISLLFLFSSAYSEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 477 - protein, 238 aa, Artificial Sequence
  VP8* aa21-240 P[4] SP(IgE)
MDWTWILFLVAAATRVHSEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 478 - protein, 238 aa, Artificial Sequence
  VP8* aa21-240 P[6] SP(IgE)
MDWTWILFLVAAATRVHSEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 479 - protein, 238 aa, Artificial Sequence
  VP8* aa21-240 P[8] SP(IgE)
MDWTWILFLVAAATRVHSEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 480 - protein, 238 aa, Artificial Sequence
  VP8* aa21-240 P[8]-VirWa SP(IgE)
MDWTWILFLVAAATRVHSEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 481 - protein, 244 aa, Artificial Sequence
  VP8* aa21-240 P[4] SP(CD5)
MPMGSLQPLATLYLLGMLVASCLGEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 482 - protein, 244 aa, Artificial Sequence
  VP8* aa21-240 P[6] SP(CD5)
MPMGSLQPLATLYLLGMLVASCLGEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 483 - protein, 244 aa, Artificial Sequence
  VP8* aa21-240 P[8] SP(CD5)
MPMGSLQPLATLYLLGMLVASCLGEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 484 - protein, 244 aa, Artificial Sequence
  VP8* aa21-240 P[8]-VirWa SP(CD5)
MPMGSLQPLATLYLLGMLVASCLGEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 485 - protein, 244 aa, Artificial Sequence
  VP8* aa21-240 P[4] SP(HLA-A2)
MAVMAPRTLVLLLSGALALTQTWAEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 486 - protein, 244 aa, Artificial Sequence
  VP8* aa21-240 P[6] SP(HLA-A2)
MAVMAPRTLVLLLSGALALTQTWAEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 487 - protein, 244 aa, Artificial Sequence
  VP8* aa21-240 P[8] SP(HLA-A2)
MAVMAPRTLVLLLSGALALTQTWAEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 488 - protein, 244 aa, Artificial Sequence
  VP8* aa21-240 P[8]-VirWa SP(HLA-A2)
MAVMAPRTLVLLLSGALALTQTWAEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 489 - protein, 261 aa, Artificial Sequence
  VP8* aa21-240 P[4] SP(TPA)+P2+Linker
MDAMKRGLCCVLLLCGAVFVSQYIKANSKFIGITELGSGSGEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 490 - protein, 261 aa, Artificial Sequence
  VP8* aa21-240 P[6] SP(TPA)+P2+Linker
MDAMKRGLCCVLLLCGAVFVSQYIKANSKFIGITELGSGSGEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 491 - protein, 261 aa, Artificial Sequence
  VP8* aa21-240 P[8] SP(TPA)+P2+Linker
MDAMKRGLCCVLLLCGAVFVSQYIKANSKFIGITELGSGSGEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 492 - protein, 261 aa, Artificial Sequence
  VP8* aa21-240 P[8]-VirWa SP(TPA)+P2+Linker
MDAMKRGLCCVLLLCGAVFVSQYIKANSKFIGITELGSGSGEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 493 - protein, 258 aa, Artificial Sequence
  VP8* aa21-240 P[4] SP(HSA)+P2+Linker
MKWVTFISLLFLFSSAYSQYIKANSKFIGITELGSGSGEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 494 - protein, 258 aa, Artificial Sequence
  VP8* aa21-240 P[6] SP(HSA)+P2+Linker
MKWVTFISLLFLFSSAYSQYIKANSKFIGITELGSGSGEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 495 - protein, 258 aa, Artificial Sequence
  VP8* aa21-240 P[8] SP(HSA)+P2+Linker
MKWVTFISLLFLFSSAYSQYIKANSKFIGITELGSGSGEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 496 - protein, 258 aa, Artificial Sequence
  VP8* aa21-240 P[8]-VirWa SP(HSA)+P2+Linker
MKWVTFISLLFLFSSAYSQYIKANSKFIGITELGSGSGEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 497 - protein, 258 aa, Artificial Sequence
  VP8* aa21-240 P[4] SP(IgE)+P2+Linker
MDWTWILFLVAAATRVHSQYIKANSKFIGITELGSGSGEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 498 - protein, 258 aa, Artificial Sequence
  VP8* aa21-240 P[6] SP(IgE)+P2+Linker
MDWTWILFLVAAATRVHSQYIKANSKFIGITELGSGSGEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 499 - protein, 258 aa, Artificial Sequence
  VP8* aa21-240 P[8] SP(IgE)+P2+Linker
MDWTWILFLVAAATRVHSQYIKANSKFIGITELGSGSGEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 500 - protein, 258 aa, Artificial Sequence
  VP8* aa21-240 P[8]-VirWa SP(IgE)+P2+Linker
MDWTWILFLVAAATRVHSQYIKANSKFIGITELGSGSGEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 501 - protein, 264 aa, Artificial Sequence
  VP8* aa21-240 P[4] SP(CD5)+P2+Linker
MPMGSLQPLATLYLLGMLVASCLGQYIKANSKFIGITELGSGSGEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 502 - protein, 264 aa, Artificial Sequence
  VP8* aa21-240 P[6] SP(CD5)+P2+Linker
MPMGSLQPLATLYLLGMLVASCLGQYIKANSKFIGITELGSGSGEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 503 - protein, 264 aa, Artificial Sequence
  VP8* aa21-240 P[8] SP(CD5)+P2+Linker
MPMGSLQPLATLYLLGMLVASCLGQYIKANSKFIGITELGSGSGEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 504 - protein, 264 aa, Artificial Sequence
  VP8* aa21-240 P[8]-VirWa SP(CD5)+P2+Linker
MPMGSLQPLATLYLLGMLVASCLGQYIKANSKFIGITELGSGSGEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 505 - protein, 264 aa, Artificial Sequence
  VP8* aa21-240 P[4] SP(HLA-A2)+P2+Linker
MAVMAPRTLVLLLSGALALTQTWAQYIKANSKFIGITELGSGSGEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 506 - protein, 264 aa, Artificial Sequence
  VP8* aa21-240 P[6] SP(HLA-A2)+P2+Linker
MAVMAPRTLVLLLSGALALTQTWAQYIKANSKFIGITELGSGSGEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 507 - protein, 264 aa, Artificial Sequence
  VP8* aa21-240 P[8] SP(HLA-A2)+P2+Linker
MAVMAPRTLVLLLSGALALTQTWAQYIKANSKFIGITELGSGSGEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 508 - protein, 264 aa, Artificial Sequence
  VP8* aa21-240 P[8]-VirWa SP(HLA-A2)+P2+Linker
MAVMAPRTLVLLLSGALALTQTWAQYIKANSKFIGITELGSGSGEIEQIGSEKTQNVTINPSPFAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGLPPIQNTRNVVPLPLSSR

SEQ ID NO: 509 - protein, 221 aa, Artificial Sequence
  VP8* aa21-240 P[4] w/o glyco
MEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 510 - protein, 221 aa, Artificial Sequence
  VP8* aa21-240 P[6] w/o glyco
MEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 511 - protein, 221 aa, Artificial Sequence
  VP8* aa21-240 P[8] w/o glyco
MEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 512 - protein, 221 aa, Artificial Sequence
  VP8* aa21-240 P[8]-VirWa w/o glyco
MEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 513 - protein, 241 aa, Artificial Sequence
  VP8* aa21-240 P[4] P2+Linker w/o glyco
MQYIKANSKFIGITELGSGSGEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 514 - protein, 241 aa, Artificial Sequence
  VP8* aa21-240 P[6] P2+Linker w/o glyco
MQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 515 - protein, 241 aa, Artificial Sequence
  VP8* aa21-240 P[8] P2+Linker w/o glyco
MQYIKANSKFIGITELGSGSGEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 516 - protein, 241 aa, Artificial Sequence
  VP8* aa21-240 P[8]-VirWa P2+Linker w/o glyco
MQYIKANSKFIGITELGSGSGEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 517 - protein, 241 aa, Artificial Sequence
  VP8* aa21-240 P[4] SP(TPA) w/o glyco
MDAMKRGLCCVLLLCGAVFVSEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 518 - protein, 241 aa, Artificial Sequence
  VP8* aa21-240 P[6] SP(TPA) w/o glyco
MDAMKRGLCCVLLLCGAVFVSEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 519 - protein, 241 aa, Artificial Sequence
  VP8* aa21-240 P[8] SP(TPA) w/o glyco
MDAMKRGLCCVLLLCGAVFVSEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 520 - protein, 241 aa, Artificial Sequence
  VP8* aa21-240 P[8]-VirWa SP(TPA) w/o glyco
MDAMKRGLCCVLLLCGAVFVSEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 521 - protein, 238 aa, Artificial Sequence
  VP8* aa21-240 P[4] SP(HSA) w/o glyco
MKWVTFISLLFLFSSAYSEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 522 - protein, 238 aa, Artificial Sequence
  VP8* aa21-240 P[6] SP(HSA) w/o glyco
MKWVTFISLLFLFSSAYSEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 523 - protein, 238 aa, Artificial Sequence
  VP8* aa21-240 P[8] SP(HSA) w/o glyco
MKWVTFISLLFLFSSAYSEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 524 - protein, 238 aa, Artificial Sequence
  VP8* aa21-240 P[8]-VirWa SP(HSA) w/o glyco
MKWVTFISLLFLFSSAYSEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 525 - protein, 238 aa, Artificial Sequence
  VP8* aa21-240 P[4] SP(IgE) w/o glyco
MDWTWILFLVAAATRVHSEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 526 - protein, 238 aa, Artificial Sequence
  VP8* aa21-240 P[6] SP(IgE) w/o glyco
MDWTWILFLVAAATRVHSEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 527 - protein, 238 aa, Artificial Sequence
  VP8* aa21-240 P[8] SP(IgE) w/o glyco
MDWTWILFLVAAATRVHSEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 528 - protein, 238 aa, Artificial Sequence
  VP8* aa21-240 P[8]-VirWa SP(IgE) w/o glyco
MDWTWILFLVAAATRVHSEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 529 - protein, 244 aa, Artificial Sequence
  VP8* aa21-240 P[4] SP(CD5) w/o glyco
MPMGSLQPLATLYLLGMLVASCLGEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 530 - protein, 244 aa, Artificial Sequence
  VP8* aa21-240 P[6] SP(CD5) w/o glyco
MPMGSLQPLATLYLLGMLVASCLGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 531 - protein, 244 aa, Artificial Sequence
  VP8* aa21-240 P[8] SP(CD5) w/o glyco
MPMGSLQPLATLYLLGMLVASCLGEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 532 - protein, 244 aa, Artificial Sequence
  VP8* aa21-240 P[8]-VirWa SP(CD5) w/o glyco
MPMGSLQPLATLYLLGMLVASCLGEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 533 - protein, 244 aa, Artificial Sequence
  VP8* aa21-240 P[4] SP(HLA-A2) w/o glyco
MAVMAPRTLVLLLSGALALTQTWAEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 534 - protein, 244 aa, Artificial Sequence
  VP8* aa21-240 P[6] SP(HLA-A2) w/o glyco
MAVMAPRTLVLLLSGALALTQTWAEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 535 - protein, 244 aa, Artificial Sequence
  VP8* aa21-240 P[8] SP(HLA-A2) w/o glyco
MAVMAPRTLVLLLSGALALTQTWAEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 536 - protein, 244 aa, Artificial Sequence
  VP8* aa21-240 P[8]-VirWa SP(HLA-A2) w/o glyco
MAVMAPRTLVLLLSGALALTQTWAEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 537 - protein, 261 aa, Artificial Sequence
  VP8* aa21-240 P[4] SP(TPA)+P2+Linker w/o glyco
MDAMKRGLCCVLLLCGAVFVSQYIKANSKFIGITELGSGSGEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 538 - protein, 261 aa, Artificial Sequence
  VP8* aa21-240 P[6] SP(TPA)+P2+Linker w/o glyco
MDAMKRGLCCVLLLCGAVFVSQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 539 - protein, 261 aa, Artificial Sequence
  VP8* aa21-240 P[8] SP(TPA)+P2+Linker w/o glyco
MDAMKRGLCCVLLLCGAVFVSQYIKANSKFIGITELGSGSGEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 540 - protein, 261 aa, Artificial Sequence
  VP8* aa21-240 P[8]-VirWa SP(TPA)+P2+Linker w/o glyco
MDAMKRGLCCVLLLCGAVFVSQYIKANSKFIGITELGSGSGEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 541 - protein, 258 aa, Artificial Sequence
  VP8* aa21-240 P[4] SP(HSA)+P2+Linker w/o glyco
MKWVTFISLLFLFSSAYSQYIKANSKFIGITELGSGSGEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 542 - protein, 258 aa, Artificial Sequence
  VP8* aa21-240 P[6] SP(HSA)+P2+Linker w/o glyco
MKWVTFISLLFLFSSAYSQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 543 - protein, 258 aa, Artificial Sequence
  VP8* aa21-240 P[8] SP(HSA)+P2+Linker w/o glyco
MKWVTFISLLFLFSSAYSQYIKANSKFIGITELGSGSGEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 544 - protein, 258 aa, Artificial Sequence
  VP8* aa21-240 P[8]-VirWa SP(HSA)+P2+Linker w/o glyco
MKWVTFISLLFLFSSAYSQYIKANSKFIGITELGSGSGEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 545 - protein, 258 aa, Artificial Sequence
  VP8* aa21-240 P[4] SP(IgE)+P2+Linker w/o glyco
MDWTWILFLVAAATRVHSQYIKANSKFIGITELGSGSGEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 546 - protein, 258 aa, Artificial Sequence
  VP8* aa21-240 P[6] SP(IgE)+P2+Linker w/o glyco
MDWTWILFLVAAATRVHSQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 547 - protein, 258 aa, Artificial Sequence
  VP8* aa21-240 P[8] SP(IgE)+P2+Linker w/o glyco
MDWTWILFLVAAATRVHSQYIKANSKFIGITELGSGSGEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 548 - protein, 258 aa, Artificial Sequence
  VP8* aa21-240 P[8]-VirWa SP(IgE)+P2+Linker w/o glyco
MDWTWILFLVAAATRVHSQYIKANSKFIGITELGSGSGEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 549 - protein, 264 aa, Artificial Sequence
  VP8* aa21-240 P[4] SP(CD5)+P2+Linker w/o glyco
MPMGSLQPLATLYLLGMLVASCLGQYIKANSKFIGITELGSGSGEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 550 - protein, 264 aa, Artificial Sequence
  VP8* aa21-240 P[6] SP(CD5)+P2+Linker w/o glyco
MPMGSLQPLATLYLLGMLVASCLGQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 551 - protein, 264 aa, Artificial Sequence
  VP8* aa21-240 P[8] SP(CD5)+P2+Linker w/o glyco
MPMGSLQPLATLYLLGMLVASCLGQYIKANSKFIGITELGSGSGEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 552 - protein, 264 aa, Artificial Sequence
  VP8* aa21-240 P[8]-VirWa SP(CD5)+P2+Linker w/o glyco
MPMGSLQPLATLYLLGMLVASCLGQYIKANSKFIGITELGSGSGEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 553 - protein, 264 aa, Artificial Sequence
  VP8* aa21-240 P[4] SP(HLA-A2)+P2+Linker w/o glyco
MAVMAPRTLVLLLSGALALTQTWAQYIKANSKFIGITELGSGSGEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGLPPIQNTRQVVPLSLSSR

SEQ ID NO: 554 - protein, 264 aa, Artificial Sequence
  VP8* aa21-240 P[6] SP(HLA-A2)+P2+Linker w/o glyco
MAVMAPRTLVLLLSGALALTQTWAQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRNIVPVALSSR

SEQ ID NO: 555 - protein, 264 aa, Artificial Sequence
  VP8* aa21-240 P[8] SP(HLA-A2)+P2+Linker w/o glyco
MAVMAPRTLVLLLSGALALTQTWAQYIKANSKFIGITELGSGSGEIEQIGSEKTQQVTVNPGPFAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGLPPIQNTRQVVPLSLSSR

SEQ ID NO: 556 - protein, 264 aa, Artificial Sequence
  VP8* aa21-240 P[8]-VirWa SP(HLA-A2)+P2+Linker w/o glyco
MAVMAPRTLVLLLSGALALTQTWAQYIKANSKFIGITELGSGSGEIEQIGSEKTQQVTINPSPFAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGLPPIQNTRQVVPLPLSSR

SEQ ID NO: 557 - protein, 184 aa, Artificial Sequence
  VP8* aa41-223P[4]
MAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 558 - protein, 184 aa, Artificial Sequence
  VP8* aa41-223P[6]
MAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 559 - protein, 184 aa, Artificial Sequence
  VP8* aa41-223P[8]
MAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 560 - protein, 184 aa, Artificial Sequence
  VP8* aa41-223P[8]-VirWa
MAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 561 - protein, 204 aa, Artificial Sequence
  VP8* aa41-223P[4] P2+Linker
MQYIKANSKFIGITELGSGSGAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 562 - protein, 204 aa, Artificial Sequence
  VP8* aa41-223P[6] P2+Linker
MQYIKANSKFIGITELGSGSGAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 563 - protein, 204 aa, Artificial Sequence
  VP8* aa41-223P[8] P2+Linker
MQYIKANSKFIGITELGSGSGAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 564 - protein, 204 aa, Artificial Sequence
  VP8* aa41-223P[8]-VirWa P2+Linker
MQYIKANSKFIGITELGSGSGAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 565 - protein, 204 aa, Artificial Sequence
  VP8* aa41-223P[4] SP(TPA)
MDAMKRGLCCVLLLCGAVFVSAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 566 - protein, 204 aa, Artificial Sequence
  VP8* aa41-223P[6] SP(TPA)
MDAMKRGLCCVLLLCGAVFVSAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 567 - protein, 204 aa, Artificial Sequence
  VP8* aa41-223P[8] SP(TPA)
MDAMKRGLCCVLLLCGAVFVSAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 568 - protein, 204 aa, Artificial Sequence
  VP8* aa41-223P[8]-VirWa SP(TPA)
MDAMKRGLCCVLLLCGAVFVSAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 569 - protein, 201 aa, Artificial Sequence
  VP8* aa41-223P[4] SP(HSA)
MKWVTFISLLFLFSSAYSAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 570 - protein, 201 aa, Artificial Sequence
  VP8* aa41-223P[6] SP(HSA)
MKWVTFISLLFLFSSAYSAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 571 - protein, 201 aa, Artificial Sequence
  VP8* aa41-223P[8] SP(HSA)
MKWVTFISLLFLFSSAYSAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 572 - protein, 201 aa, Artificial Sequence
  VP8* aa41-223P[8]-VirWa SP(HSA)
MKWVTFISLLFLFSSAYSAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 573 - protein, 201 aa, Artificial Sequence
  VP8* aa41-223P[4] SP(IgE)
MDWTWILFLVAAATRVHSAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 574 - protein, 201 aa, Artificial Sequence
  VP8* aa41-223P[6] SP(IgE)
MDWTWILFLVAAATRVHSAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 575 - protein, 201 aa, Artificial Sequence
  VP8* aa41-223P[8] SP(IgE)
MDWTWILFLVAAATRVHSAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 576 - protein, 201 aa, Artificial Sequence
  VP8* aa41-223P[8]-VirWa SP(IgE)
MDWTWILFLVAAATRVHSAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 577 - protein, 207 aa, Artificial Sequence
  VP8* aa41-223P[4] SP(CD5)
MPMGSLQPLATLYLLGMLVASCLGAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 578 - protein, 207 aa, Artificial Sequence
  VP8* aa41-223P[6] SP(CD5)
MPMGSLQPLATLYLLGMLVASCLGAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 579 - protein, 207 aa, Artificial Sequence
  VP8* aa41-223P[8] SP(CD5)
MPMGSLQPLATLYLLGMLVASCLGAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 580 - protein, 207 aa, Artificial Sequence
  VP8* aa41-223P[8]-VirWa SP(CD5)
MPMGSLQPLATLYLLGMLVASCLGAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 581 - protein, 207 aa, Artificial Sequence
  VP8* aa41-223P[4] SP(HLA-A2)
MAVMAPRTLVLLLSGALALTQTWAAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 582 - protein, 207 aa, Artificial Sequence
  VP8* aa41-223P[6] SP(HLA-A2)
MAVMAPRTLVLLLSGALALTQTWAAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 583 - protein, 207 aa, Artificial Sequence
  VP8* aa41-223P[8] SP(HLA-A2)
MAVMAPRTLVLLLSGALALTQTWAAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 584 - protein, 207 aa, Artificial Sequence
  VP8* aa41-223P[8]-VirWa SP(HLA-A2)
MAVMAPRTLVLLLSGALALTQTWAAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 585 - protein, 224 aa, Artificial Sequence
  VP8* aa41-223P[4] SP(TPA)+P2+Linker
MDAMKRGLCCVLLLCGAVFVSQYIKANSKFIGITELGSGSGAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 586 - protein, 224 aa, Artificial Sequence
  VP8* aa41-223P[6] SP(TPA)+P2+Linker
MDAMKRGLCCVLLLCGAVFVSQYIKANSKFIGITELGSGSGAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 587 - protein, 224 aa, Artificial Sequence
  VP8* aa41-223P[8] SP(TPA)+P2+Linker
MDAMKRGLCCVLLLCGAVFVSQYIKANSKFIGITELGSGSGAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 588 - protein, 224 aa, Artificial Sequence
  VP8* aa41-223P[8]-VirWa SP(TPA)+P2+Linker
MDAMKRGLCCVLLLCGAVFVSQYIKANSKFIGITELGSGSGAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 589 - protein, 221 aa, Artificial Sequence
  VP8* aa41-223P[4] SP(HSA)+P2+Linker
MKWVTFISLLFLFSSAYSQYIKANSKFIGITELGSGSGAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 590 - protein, 221 aa, Artificial Sequence
  VP8* aa41-223P[6] SP(HSA)+P2+Linker
MKWVTFISLLFLFSSAYSQYIKANSKFIGITELGSGSGAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 591 - protein, 221 aa, Artificial Sequence
  VP8* aa41-223P[8] SP(HSA)+P2+Linker
MKWVTFISLLFLFSSAYSQYIKANSKFIGITELGSGSGAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 592 - protein, 221 aa, Artificial Sequence
  VP8* aa41-223P[8]-VirWa SP(HSA)+P2+Linker
MKWVTFISLLFLFSSAYSQYIKANSKFIGITELGSGSGAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 593 - protein, 221 aa, Artificial Sequence
  VP8* aa41-223P[4] SP(IgE)+P2+Linker
MDWTWILFLVAAATRVHSQYIKANSKFIGITELGSGSGAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 594 - protein, 221 aa, Artificial Sequence
  VP8* aa41-223P[6] SP(IgE)+P2+Linker
MDWTWILFLVAAATRVHSQYIKANSKFIGITELGSGSGAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 595 - protein, 221 aa, Artificial Sequence
  VP8* aa41-223P[8] SP(IgE)+P2+Linker
MDWTWILFLVAAATRVHSQYIKANSKFIGITELGSGSGAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 596 - protein, 221 aa, Artificial Sequence
  VP8* aa41-223P[8]-VirWa SP(IgE)+P2+Linker
MDWTWILFLVAAATRVHSQYIKANSKFIGITELGSGSGAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 597 - protein, 227 aa, Artificial Sequence
  VP8* aa41-223P[4] SP(CD5)+P2+Linker
MPMGSLQPLATLYLLGMLVASCLGQYIKANSKFIGITELGSGSGAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 598 - protein, 227 aa, Artificial Sequence
  VP8* aa41-223P[6] SP(CD5)+P2+Linker
MPMGSLQPLATLYLLGMLVASCLGQYIKANSKFIGITELGSGSGAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 599 - protein, 227 aa, Artificial Sequence
  VP8* aa41-223P[8] SP(CD5)+P2+Linker
MPMGSLQPLATLYLLGMLVASCLGQYIKANSKFIGITELGSGSGAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 600 - protein, 227 aa, Artificial Sequence
  VP8* aa41-223P[8]-VirWa SP(CD5)+P2+Linker
MPMGSLQPLATLYLLGMLVASCLGQYIKANSKFIGITELGSGSGAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 601 - protein, 227 aa, Artificial Sequence
  VP8* aa41-223P[4] SP(HLA-A2)+P2+Linker
MAVMAPRTLVLLLSGALALTQTWAQYIKANSKFIGITELGSGSGAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 602 - protein, 227 aa, Artificial Sequence
  VP8* aa41-223P[6] SP(HLA-A2)+P2+Linker
MAVMAPRTLVLLLSGALALTQTWAQYIKANSKFIGITELGSGSGAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 603 - protein, 227 aa, Artificial Sequence
  VP8* aa41-223P[8] SP(HLA-A2)+P2+Linker
MAVMAPRTLVLLLSGALALTQTWAQYIKANSKFIGITELGSGSGAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 604 - protein, 227 aa, Artificial Sequence
  VP8* aa41-223P[8]-VirWa SP(HLA-A2)+P2Linker
MAVMAPRTLVLLLSGALALTQTWAQYIKANSKFIGITELGSGSGAQTRYAPVNWGHGEINDSTTVEPILDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 605 - protein, 184 aa, Artificial Sequence
  VP8* aa41-223P[4] w/o glyco
MAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 606 - protein, 184 aa, Artificial Sequence
  VP8* aa41-223P[6] w/o glyco
MAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 607 - protein, 184 aa, Artificial Sequence
  VP8* aa41-223P[8] w/o glyco
MAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 608 - protein, 184 aa, Artificial Sequence
  VP8* aa41-223P[8]-VirWa w/o glyco
MAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 609 - protein, 204 aa, Artificial Sequence
  VP8* aa41-223P[4] P2+Linker w/o glyco
MQYIKANSKFIGITELGSGSGAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 610 - protein, 204 aa, Artificial Sequence
  VP8* aa41-223P[6] P2+Linker w/o glyco
MQYIKANSKFIGITELGSGSGAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 611 - protein, 204 aa, Artificial Sequence
  VP8* aa41-223P[8] P2+Linker w/o glyco
MQYIKANSKFIGITELGSGSGAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 612 - protein, 204 aa, Artificial Sequence
  VP8* aa41-223P[8]-VirWa P2+Linker w/o glyco
MQYIKANSKFIGITELGSGSGAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 613 - protein, 204 aa, Artificial Sequence
  VP8* aa41-223P[4] SP(TPA) w/o glyco
MDAMKRGLCCVLLLCGAVFVSAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 614 - protein, 204 aa, Artificial Sequence
  VP8* aa41-223P[6] SP(TPA) w/o glyco
MDAMKRGLCCVLLLCGAVFVSAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 615 - protein, 204 aa, Artificial Sequence
  VP8* aa41-223P[8] SP(TPA) w/o glyco
MDAMKRGLCCVLLLCGAVFVSAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 616 - protein, 204 aa, Artificial Sequence
  VP8* aa41-223P[8]-VirWa SP(TPA) w/o glyco
MDAMKRGLCCVLLLCGAVFVSAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 617 - protein, 201 aa, Artificial Sequence
  VP8* aa41-223P[4] SP(HSA) w/o glyco
MKWVTFISLLFLFSSAYSAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 618 - protein, 201 aa, Artificial Sequence
  VP8* aa41-223P[6] SP(HSA) w/o glyco
MKWVTFISLLFLFSSAYSAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 619 - protein, 201 aa, Artificial Sequence
  VP8* aa41-223P[8] SP(HSA) w/o glyco
MKWVTFISLLFLFSSAYSAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 620 - protein, 201 aa, Artificial Sequence
  VP8* aa41-223P[8]-VirWa SP(HSA) w/o glyco
MKWVTFISLLFLFSSAYSAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 621 - protein, 201 aa, Artificial Sequence
  VP8* aa41-223P[4] SP(IgE) w/o glyco
MDWTWILFLVAAATRVHSAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 622 - protein, 201 aa, Artificial Sequence
  VP8* aa41-223P[6] SP(IgE) w/o glyco
MDWTWILFLVAAATRVHSAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 623 - protein, 201 aa, Artificial Sequence
  VP8* aa41-223P[8] SP(IgE) w/o glyco
MDWTWILFLVAAATRVHSAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 624 - protein, 201 aa, Artificial Sequence
  VP8* aa41-223P[8]-VirWa SP(IgE) w/o glyco
MDWTWILFLVAAATRVHSAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 625 - protein, 207 aa, Artificial Sequence
  VP8* aa41-223P[4] SP(CD5) w/o glyco
MPMGSLQPLATLYLLGMLVASCLGAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 626 - protein, 207 aa, Artificial Sequence
  VP8* aa41-223P[6] SP(CD5) w/o glyco
MPMGSLQPLATLYLLGMLVASCLGAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 627 - protein, 207 aa, Artificial Sequence
  VP8* aa41-223P[8] SP(CD5) w/o glyco
MPMGSLQPLATLYLLGMLVASCLGAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 628 - protein, 207 aa, Artificial Sequence
  VP8* aa41-223P[8]-VirWa SP(CD5) w/o glyco
MPMGSLQPLATLYLLGMLVASCLGAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 629 - protein, 207 aa, Artificial Sequence
  VP8* aa41-223P[4] SP(HLA-A2) w/o glyco
MAVMAPRTLVLLLSGALALTQTWAAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 630 - protein, 207 aa, Artificial Sequence
  VP8* aa41-223P[6] SP(HLA-A2) w/o glyco
MAVMAPRTLVLLLSGALALTQTWAAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 631 - protein, 207 aa, Artificial Sequence
  VP8* aa41-223P[8] SP(HLA-A2) w/o glyco
MAVMAPRTLVLLLSGALALTQTWAAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 632 - protein, 207 aa, Artificial Sequence
  VP8* aa41-223P[8]-VirWa SP(HLA-A2) w/o glyco
MAVMAPRTLVLLLSGALALTQTWAAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 633 - protein, 224 aa, Artificial Sequence
  VP8* aa41-223P[4] SP(TPA)+P2+Linker w/o glyco
MDAMKRGLCCVLLLCGAVFVSQYIKANSKFIGITELGSGSGAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 634 - protein, 224 aa, Artificial Sequence
  VP8* aa41-223P[6] SP(TPA)+P2+Linker w/o glyco
MDAMKRGLCCVLLLCGAVFVSQYIKANSKFIGITELGSGSGAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 635 - protein, 224 aa, Artificial Sequence
  VP8* aa41-223P[8] SP(TPA)+P2+Linker w/o glyco
MDAMKRGLCCVLLLCGAVFVSQYIKANSKFIGITELGSGSGAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 636 - protein, 224 aa, Artificial Sequence
  VP8* aa41-223P[8]-VirWa SP(TPA)+P2+Linker w/o glyco
MDAMKRGLCCVLLLCGAVFVSQYIKANSKFIGITELGSGSGAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 637 - protein, 221 aa, Artificial Sequence
  VP8* aa41-223P[4] SP(HSA)+P2+Linker w/o glyco
MKWVTFISLLFLFSSAYSQYIKANSKFIGITELGSGSGAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 638 - protein, 221 aa, Artificial Sequence
  VP8* aa41-223P[6] SP(HSA)+P2+Linker w/o glyco
MKWVTFISLLFLFSSAYSQYIKANSKFIGITELGSGSGAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 639 - protein, 221 aa, Artificial Sequence
  VP8* aa41-223P[8] SP(HSA)+P2+Linker w/o glyco
MKWVTFISLLFLFSSAYSQYIKANSKFIGITELGSGSGAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 640 - protein, 221 aa, Artificial Sequence
  VP8* aa41-223P[8]-VirWa SP(HSA)+P2+Linker w/o glyco
MKWVTFISLLFLFSSAYSQYIKANSKFIGITELGSGSGAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 641 - protein, 221 aa, Artificial Sequence
  VP8* aa41-223P[4] SP(IgE)+P2+Linker w/o glyco
MDWTWILFLVAAATRVHSQYIKANSKFIGITELGSGSGAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 642 - protein, 221 aa, Artificial Sequence
  VP8* aa41-223P[6] SP(IgE)+P2+Linker w/o glyco
MDWTWILFLVAAATRVHSQYIKANSKFIGITELGSGSGAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 643 - protein, 221 aa, Artificial Sequence
  VP8* aa41-223P[8] SP(IgE)+P2+Linker w/o glyco
MDWTWILFLVAAATRVHSQYIKANSKFIGITELGSGSGAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 644 - protein, 221 aa, Artificial Sequence
  VP8* aa41-223P[8]-VirWa SP(IgE)+P2+Linker w/o glyco
MDWTWILFLVAAATRVHSQYIKANSKFIGITELGSGSGAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 645 - protein, 227 aa, Artificial Sequence
  VP8* aa41-223P[4] SP(CD5)+P2+Linker w/o glyco
MPMGSLQPLATLYLLGMLVASCLGQYIKANSKFIGITELGSGSGAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 646 - protein, 227 aa, Artificial Sequence
  VP8* aa41-223P[6] SP(CD5)+P2+Linker w/o glyco
MPMGSLQPLATLYLLGMLVASCLGQYIKANSKFIGITELGSGSGAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 647 - protein, 227 aa, Artificial Sequence
  VP8* aa41-223P[8] SP(CD5)+P2+Linker w/o glyco
MPMGSLQPLATLYLLGMLVASCLGQYIKANSKFIGITELGSGSGAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 648 - protein, 227 aa, Artificial Sequence
  VP8* aa41-223 P[8]-VirWa SP(CD5)+P2+Linker w/o glyco
MPMGSLQPLATLYLLGMLVASCLGQYIKANSKFIGITELGSGSGAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 649 - protein, 227 aa, Artificial Sequence
  VP8* aa41-223P[4] SP(HLA-A2)+P2+Linker w/o glyco
MAVMAPRTLVLLLSGALALTQTWAQYIKANSKFIGITELGSGSGAQTRYAPVNWGHGEIQDSTTVEPVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 650 - protein, 227 aa, Artificial Sequence
  VP8* aa41-223 P[6] SP(HLA-A2)+P2+Linker w/o glyco
MAVMAPRTLVLLLSGALALTQTWAQYIKANSKFIGITELGSGSGAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 651 - protein, 227 aa, Artificial Sequence
  VP8* aa41-223 P[8] SP(HLA-A2)+P2+Linker w/o glyco
MAVMAPRTLVLLLSGALALTQTWAQYIKANSKFIGITELGSGSGAQTRYAPVNWGHGEIQDSTTVEPILDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 652 - protein, 227 aa, Artificial Sequence
  VP8* aa41-223P[8]-VirWa SP(HLA-A2)+P2+Linker w/o glyco
MAVMAPRTLVLLLSGALALTQTWAQYIKANSKFIGITELGSGSGAQTRYAPVNWGHGEIQDSTTVEPILDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 653 - protein, 160 aa, Artificial Sequence
  VP8* aa65-223short P[4]
MLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 654 - protein, 160 aa, Artificial Sequence
  VP8* aa65-223short P[6]
MLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 655 - protein, 160 aa, Artificial Sequence
  VP8* aa65-223 short P[8]
MLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 656 - protein, 160 aa, Artificial Sequence
  VP8* aa65-223short P[8]-VirWa
MLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 657 - protein, 180 aa, Artificial Sequence
  VP8* aa65-223short P[4] P2+Linker
MQYIKANSKFIGITELGSGSGLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 658 - protein, 180 aa, Artificial Sequence
  VP8* aa65-223short P[6] P2+Linker
MQYIKANSKFIGITELGSGSGLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 659 - protein, 180 aa, Artificial Sequence
  VP8* aa65-223 short P[8] P2+Linker
MQYIKANSKFIGITELGSGSGLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 660 - protein, 180 aa, Artificial Sequence
  VP8* aa65-223short P[8]-VirWa P2+Linker
MQYIKANSKFIGITELGSGSGLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 661 - protein, 180 aa, Artificial Sequence
  VP8* aa65-223short P[4] SP(TPA)
MDAMKRGLCCVLLLCGAVFVSLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 662 - protein, 180 aa, Artificial Sequence
  VP8* aa65-223short P[6] SP(TPA)
MDAMKRGLCCVLLLCGAVFVSLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 663 - protein, 180 aa, Artificial Sequence
  VP8* aa65-223 short P[8] SP(TPA)
MDAMKRGLCCVLLLCGAVFVSLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 664 - protein, 180 aa, Artificial Sequence
  VP8* aa65-223short P[8]-VirWa SP(TPA)
MDAMKRGLCCVLLLCGAVFVSLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 665 - protein, 177 aa, Artificial Sequence
  VP8* aa65-223short P[4] SP(HSA)
MKWVTFISLLFLFSSAYSLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 666 - protein, 177 aa, Artificial Sequence
  VP8* aa65-223short P[6] SP(HSA)
MKWVTFISLLFLFSSAYSLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 667 - protein, 177 aa, Artificial Sequence
  VP8* aa65-223 short P[8] SP(HSA)
MKWVTFISLLFLFSSAYSLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 668 - protein, 177 aa, Artificial Sequence
  VP8* aa65-223short P[8]-VirWa SP(HSA)
MKWVTFISLLFLFSSAYSLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 669 - protein, 177 aa, Artificial Sequence
  VP8* aa65-223short P[4] SP(IgE)
MDWTWILFLVAAATRVHSLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 670 - protein, 177 aa, Artificial Sequence
  VP8* aa65-223short P[6]SP(IgE)
MDWTWILFLVAAATRVHSLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 671 - protein, 177 aa, Artificial Sequence
  VP8* aa65-223 short P[8] SP(IgE)
MDWTWILFLVAAATRVHSLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 672 - protein, 177 aa, Artificial Sequence
  VP8* aa65-223short P[8]-VirWa SP(IgE)
MDWTWILFLVAAATRVHSLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 673 - protein, 183 aa, Artificial Sequence
  VP8* aa65-223short P[4] SP(CD5)
MPMGSLQPLATLYLLGMLVASCLGLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 674 - protein, 183 aa, Artificial Sequence
  VP8* aa65-223short P[6] SP(CD5)
MPMGSLQPLATLYLLGMLVASCLGLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 675 - protein, 183 aa, Artificial Sequence
  VP8* aa65-223 short P[8] SP(CD5)
MPMGSLQPLATLYLLGMLVASCLGLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 676 - protein, 183 aa, Artificial Sequence
  VP8* aa65-223short P[8]-VirWa SP(CD5)
MPMGSLQPLATLYLLGMLVASCLGLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 677 - protein, 183 aa, Artificial Sequence
  VP8* aa65-223short P[4] SP(HLA-A2)
MAVMAPRTLVLLLSGALALTQTWALDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 678 - protein, 183 aa, Artificial Sequence
  VP8* aa65-223short P[6] SP(HLA-A2)
MAVMAPRTLVLLLSGALALTQTWALDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 679 - protein, 183 aa, Artificial Sequence
  VP8* aa65-223 short P[8] SP(HLA-A2)
MAVMAPRTLVLLLSGALALTQTWALDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 680 - protein, 183 aa, Artificial Sequence
  VP8* aa65-223short P[8]-VirWa SP(HLA-A2)
MAVMAPRTLVLLLSGALALTQTWALDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 681 - protein, 200 aa, Artificial Sequence
  VP8* aa65-223short P[4] SP(TPA)+P2+Linker
MDAMKRGLCCVLLLCGAVFVSQYIKANSKFIGITELGSGSGLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 682 - protein, 200 aa, Artificial Sequence
  VP8* aa65-223short P[6] SP(TPA)+P2+Linker
MDAMKRGLCCVLLLCGAVFVSQYIKANSKFIGITELGSGSGLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 683 - protein, 200 aa, Artificial Sequence
  VP8* aa65-223 short P[8] SP(TPA)+P2+Linker
MDAMKRGLCCVLLLCGAVFVSQYIKANSKFIGITELGSGSGLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 684 - protein, 200 aa, Artificial Sequence
  VP8* aa65-223short P[8]-VirWa SP(TPA)+P2+Linker
MDAMKRGLCCVLLLCGAVFVSQYIKANSKFIGITELGSGSGLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 685 - protein, 197 aa, Artificial Sequence
  VP8* aa65-223short P[4] SP(HSA)+P2+Linker
MKWVTFISLLFLFSSAYSQYIKANSKFIGITELGSGSGLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 686 - protein, 197 aa, Artificial Sequence
  VP8* aa65-223short P[6] SP(HSA)+P2+Linker
MKWVTFISLLFLFSSAYSQYIKANSKFIGITELGSGSGLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 687 - protein, 197 aa, Artificial Sequence
  VP8* aa65-223 short P[8] SP(HSA)+P2+Linker
MKWVTFISLLFLFSSAYSQYIKANSKFIGITELGSGSGLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 688 - protein, 197 aa, Artificial Sequence
  VP8* aa65-223short P[8]-VirWa SP(HSA)+P2+Linker
MKWVTFISLLFLFSSAYSQYIKANSKFIGITELGSGSGLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 689 - protein, 197 aa, Artificial Sequence
  VP8* aa65-223short P[4] SP(IgE)+P2+Linker
MDWTWILFLVAAATRVHSQYIKANSKFIGITELGSGSGLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 690 - protein, 197 aa, Artificial Sequence
  VP8* aa65-223short P[6] SP(IgE)+P2+Linker
MDWTWILFLVAAATRVHSQYIKANSKFIGITELGSGSGLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 691 - protein, 197 aa, Artificial Sequence
  VP8* aa65-223 short P[8] SP(IgE)+P2+Linker
MDWTWILFLVAAATRVHSQYIKANSKFIGITELGSGSGLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 692 - protein, 197 aa, Artificial Sequence
  VP8* aa65-223short P[8]-VirWa SP(IgE)+P2+Linker
MDWTWILFLVAAATRVHSQYIKANSKFIGITELGSGSGLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 693 - protein, 203 aa, Artificial Sequence
  VP8* aa65-223short P[4] SP(CD5)+P2+Linker
MPMGSLQPLATLYLLGMLVASCLGQYIKANSKFIGITELGSGSGLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 694 - protein, 203 aa, Artificial Sequence
  VP8* aa65-223short P[6] SP(CD5)+P2+Linker
MPMGSLQPLATLYLLGMLVASCLGQYIKANSKFIGITELGSGSGLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 695 - protein, 203 aa, Artificial Sequence
  VP8* aa65-223 short P[8] SP(CD5)+P2+Linker
MPMGSLQPLATLYLLGMLVASCLGQYIKANSKFIGITELGSGSGLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 696 - protein, 203 aa, Artificial Sequence
  VP8* aa65-223short P[8]-VirWa SP(CD5)+P2+Linker
MPMGSLQPLATLYLLGMLVASCLGQYIKANSKFIGITELGSGSGLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 697 - protein, 203 aa, Artificial Sequence
  VP8* aa65-223short P[4] SP(HLA-A2)+P2+Linker
MAVMAPRTLVLLLSGALALTQTWAQYIKANSKFIGITELGSGSGLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 698 - protein, 203 aa, Artificial Sequence
  VP8* aa65-223short P[6] SP(HLA-A2)+P2+Linker
MAVMAPRTLVLLLSGALALTQTWAQYIKANSKFIGITELGSGSGLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 699 - protein, 203 aa, Artificial Sequence
  VP8* aa65-223 short P[8] SP(HLA-A2)+P2+Linker
MAVMAPRTLVLLLSGALALTQTWAQYIKANSKFIGITELGSGSGLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 700 - protein, 203 aa, Artificial Sequence
  VP8* aa65-223short P[8]-VirWa SP(HLA-A2)+P2+Linker
MAVMAPRTLVLLLSGALALTQTWAQYIKANSKFIGITELGSGSGLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 701 - protein, 160 aa, Artificial Sequence
  VP8* aa65-223short P[4] w/o glyco
MLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 702 - protein, 160 aa, Artificial Sequence
  VP8* aa65-223short P[6] w/o glyco
MLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 703 - protein, 160 aa, Artificial Sequence
  VP8* aa65-223 short P[8] w/o glyco
MLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 704 - protein, 160 aa, Artificial Sequence
  VP8* aa65-223short P[8]-VirWa w/o glyco
MLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 705 - protein, 180 aa, Artificial Sequence
  VP8* aa65-223short P[4] P2+Linker w/o glyco
MQYIKANSKFIGITELGSGSGLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 706 - protein, 180 aa, Artificial Sequence
  VP8* aa65-223short P[6] P2+Linker w/o glyco
MQYIKANSKFIGITELGSGSGLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 707 - protein, 180 aa, Artificial Sequence
  VP8* aa65-223 short P[8] P2+Linker w/o glyco
MQYIKANSKFIGITELGSGSGLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 708 - protein, 180 aa, Artificial Sequence
  VP8* aa65-223short P[8]-VirWa P2+Linker w/o glyco
MQYIKANSKFIGITELGSGSGLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 709 - protein, 180 aa, Artificial Sequence
  VP8* aa65-223short P[4] SP(TPA) w/o glyco
MDAMKRGLCCVLLLCGAVFVSLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 710 - protein, 180 aa, Artificial Sequence
  VP8* aa65-223short P[6] SP(TPA) w/o glyco
MDAMKRGLCCVLLLCGAVFVSLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 711 - protein, 180 aa, Artificial Sequence
  VP8* aa65-223 short P[8] SP(TPA) w/o glyco
MDAMKRGLCCVLLLCGAVFVSLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 712 - protein, 180 aa, Artificial Sequence
  VP8* aa65-223short P[8]-VirWa SP(TPA) w/o glyco
MDAMKRGLCCVLLLCGAVFVSLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 713 - protein, 177 aa, Artificial Sequence
  VP8* aa65-223short P[4] SP(HSA) w/o glyco
MKWVTFISLLFLFSSAYSLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 714 - protein, 177 aa, Artificial Sequence
  VP8* aa65-223short P[6] SP(HSA) w/o glyco
MKWVTFISLLFLFSSAYSLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 715 - protein, 177 aa, Artificial Sequence
  VP8* aa65-223 short P[8] SP(HSA) w/o glyco
MKWVTFISLLFLFSSAYSLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 716 - protein, 177 aa, Artificial Sequence
  VP8* aa65-223short P[8]-VirWa SP(HSA) w/o glyco
MKWVTFISLLFLFSSAYSLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 717 - protein, 177 aa, Artificial Sequence
  VP8* aa65-223short P[4] SP(IgE) w/o glyco
MDWTWILFLVAAATRVHSLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 718 - protein, 177 aa, Artificial Sequence
  VP8* aa65-223short P[6] SP(IgE) w/o glyco
MDWTWILFLVAAATRVHSLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 719 - protein, 177 aa, Artificial Sequence
  VP8* aa65-223 short P[8] SP(IgE) w/o glyco
MDWTWILFLVAAATRVHSLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 720 - protein, 177 aa, Artificial Sequence
  VP8* aa65-223short P[8]-VirWa SP(IgE) w/o glyco
MDWTWILFLVAAATRVHSLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 721 - protein, 183 aa, Artificial Sequence
  VP8* aa65-223short P[4] SP(CD5) w/o glyco
MPMGSLQPLATLYLLGMLVASCLGLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 722 - protein, 183 aa, Artificial Sequence
  VP8* aa65-223short P[6] SP(CD5) w/o glyco
MPMGSLQPLATLYLLGMLVASCLGLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 723 - protein, 183 aa, Artificial Sequence
  VP8* aa65-223 short P[8] SP(CD5) w/o glyco
MPMGSLQPLATLYLLGMLVASCLGLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 724 - protein, 183 aa, Artificial Sequence
  VP8* aa65-223short P[8]-VirWa SP(CD5) w/o glyco
MPMGSLQPLATLYLLGMLVASCLGLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 725 - protein, 183 aa, Artificial Sequence
  VP8* aa65-223short P[4] SP(HLA-A2) w/o glyco
MAVMAPRTLVLLLSGALALTQTWALDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 726 - protein, 183 aa, Artificial Sequence
  VP8* aa65-223short P[6] SP(HLA-A2) w/o glyco
MAVMAPRTLVLLLSGALALTQTWALDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 727 - protein, 183 aa, Artificial Sequence
  VP8* aa65-223 short P[8] SP(HLA-A2) w/o glyco
MAVMAPRTLVLLLSGALALTQTWALDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 728 - protein, 183 aa, Artificial Sequence
  VP8* aa65-223short P[8]-VirWa SP(HLA-A2) w/o glyco
MAVMAPRTLVLLLSGALALTQTWALDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 729 - protein, 200 aa, Artificial Sequence
  VP8* aa65-223short P[4] SP(TPA)+P2+Linker w/o glyco
MDAMKRGLCCVLLLCGAVFVSQYIKANSKFIGITELGSGSGLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 730 - protein, 200 aa, Artificial Sequence
  VP8* aa65-223short P[6] SP(TPA)+P2+Linker w/o glyco
MDAMKRGLCCVLLLCGAVFVSQYIKANSKFIGITELGSGSGLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 731 - protein, 200 aa, Artificial Sequence
  VP8* aa65-223 short P[8] SP(TPA)+P2+Linker w/o glyco
MDAMKRGLCCVLLLCGAVFVSQYIKANSKFIGITELGSGSGLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 732 - protein, 200 aa, Artificial Sequence
  VP8* aa65-223short P[8]-VirWa SP(TPA)+P2+Linker w/o glyco
MDAMKRGLCCVLLLCGAVFVSQYIKANSKFIGITELGSGSGLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 733 - protein, 197 aa, Artificial Sequence
  VP8* aa65-223short P[4] SP(HSA)+P2+Linker w/o glyco
MKWVTFISLLFLFSSAYSQYIKANSKFIGITELGSGSGLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 734 - protein, 197 aa, Artificial Sequence
  VP8* aa65-223short P[6] SP(HSA)+P2+Linker w/o glyco
MKWVTFISLLFLFSSAYSQYIKANSKFIGITELGSGSGLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 735 - protein, 197 aa, Artificial Sequence
  VP8* aa65-223 short P[8] SP(HSA)+P2+Linker w/o glyco
MKWVTFISLLFLFSSAYSQYIKANSKFIGITELGSGSGLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 736 - protein, 197 aa, Artificial Sequence
  VP8* aa65-223short P[8]-VirWa SP(HSA)+P2+Linker w/o glyco
MKWVTFISLLFLFSSAYSQYIKANSKFIGITELGSGSGLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 737 - protein, 197 aa, Artificial Sequence
  VP8* aa65-223short P[4] SP(IgE)+P2+Linker w/o glyco
MDWTWILFLVAAATRVHSQYIKANSKFIGITELGSGSGLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 738 - protein, 197 aa, Artificial Sequence
  VP8* aa65-223short P[6] SP(IgE)+P2+Linker w/o glyco
MDWTWILFLVAAATRVHSQYIKANSKFIGITELGSGSGLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 739 - protein, 197 aa, Artificial Sequence
  VP8* aa65-223 short P[8] SP(IgE)+P2+Linker w/o glyco
MDWTWILFLVAAATRVHSQYIKANSKFIGITELGSGSGLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 740 - protein, 197 aa, Artificial Sequence
  VP8* aa65-223short P[8]-VirWa SP(IgE)+P2+Linker w/o glyco
MDWTWILFLVAAATRVHSQYIKANSKFIGITELGSGSGLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 741 - protein, 203 aa, Artificial Sequence
  VP8* aa65-223short P[4] SP(CD5)+P2+Linker w/o glyco
MPMGSLQPLATLYLLGMLVASCLGQYIKANSKFIGITELGSGSGLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 742 - protein, 203 aa, Artificial Sequence
  VP8* aa65-223short P[6] SP(CD5)+P2+Linker w/o glyco
MPMGSLQPLATLYLLGMLVASCLGQYIKANSKFIGITELGSGSGLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 743 - protein, 203 aa, Artificial Sequence
  VP8* aa65-223 short P[8] SP(CD5)+P2+Linker w/o glyco
MPMGSLQPLATLYLLGMLVASCLGQYIKANSKFIGITELGSGSGLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 744 - protein, 203 aa, Artificial Sequence
  VP8* aa65-223short P[8]-VirWa SP(CD5)+P2+Linker w/o glyco
MPMGSLQPLATLYLLGMLVASCLGQYIKANSKFIGITELGSGSGLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 745 - protein, 203 aa, Artificial Sequence
  VP8* aa65-223short P[4] SP(HLA-A2)+P2+Linker w/o glyco
MAVMAPRTLVLLLSGALALTQTWAQYIKANSKFIGITELGSGSGLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 746 - protein, 203 aa, Artificial Sequence
  VP8* aa65-223short P[6] SP(HLA-A2)+P2+Linker w/o glyco
MAVMAPRTLVLLLSGALALTQTWAQYIKANSKFIGITELGSGSGLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 747 - protein, 203 aa, Artificial Sequence
  VP8* aa65-223 short P[8] SP(HLA-A2)+P2+Linker w/o glyco
MAVMAPRTLVLLLSGALALTQTWAQYIKANSKFIGITELGSGSGLDGPYQPTTFTPPTDYWILITSNTQGVVYESTQNSDFWTAVIAVEPHVNPVDRQYNVFGENKQFNVRQDSDKWKFLEMFRGSSQNDFYNRRTLTSDTRLVGILKYGGRVWTFHGETPRATTDSSNTANLDGISITIHSEFYIIPRSQESKCNEYINQGL

SEQ ID NO: 748 - protein, 203 aa, Artificial Sequence
  VP8* aa65-223short P[8]-VirWa SP(HLA-A2)+P2+Linker w/o glyco
MAVMAPRTLVLLLSGALALTQTWAQYIKANSKFIGITELGSGSGLDGPYQPTTFTPPNDYWILINSNTQGVVYESTQNSDFWTAVVAIEPHVNPVDRQYTIFGESKQFNVRQDSNKWKFLEMFRSSSQNEFYNRRTLTSDTRLVGILKYGGRVWTFHGETPRATTDSSSTANLNQISITIHSEFYIIPRSQESKCNEYINQGL

SEQ ID NO: 749 - protein, 161 aa, Artificial Sequence
  VP8* aa64-223short P[4]
MVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 750 - protein, 161 aa, Artificial Sequence
  VP8* aa64-223short P[6]
MVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 751 - protein, 181 aa, Artificial Sequence
  VP8* aa64-223short P[4] P2+Linker
MQYIKANSKFIGITELGSGSGVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 752 - protein, 181 aa, Artificial Sequence
  VP8* aa64-223short P[6] P2+Linker
MQYIKANSKFIGITELGSGSGVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 753 - protein, 181 aa, Artificial Sequence
  VP8* aa64-223short P[4] SP(TPA)
MDAMKRGLCCVLLLCGAVFVSVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 754 - protein, 181 aa, Artificial Sequence
  VP8* aa64-223short P[6] SP(TPA)
MDAMKRGLCCVLLLCGAVFVSVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 755 - protein, 178 aa, Artificial Sequence
  VP8* aa64-223short P[4] SP(HSA)
MKWVTFISLLFLFSSAYSVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 756 - protein, 178 aa, Artificial Sequence
  VP8* aa64-223short P[6] SP(HSA)
MKWVTFISLLFLFSSAYSVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 757 - protein, 178 aa, Artificial Sequence
  VP8* aa64-223short P[4] SP(IgE)
MDWTWILFLVAAATRVHSVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 758 - protein, 178 aa, Artificial Sequence
  VP8* aa64-223short P[6] SP(IgE)
MDWTWILFLVAAATRVHSVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 759 - protein, 184 aa, Artificial Sequence
  VP8* aa64-223short P[4] SP(CD5)
MPMGSLQPLATLYLLGMLVASCLGVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 760 - protein, 184 aa, Artificial Sequence
  VP8* aa64-223short P[6] SP(CD5)
MPMGSLQPLATLYLLGMLVASCLGVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 761 - protein, 184 aa, Artificial Sequence
  VP8* aa64-223short P[4] SP(HLA-A2)
MAVMAPRTLVLLLSGALALTQTWAVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 762 - protein, 184 aa, Artificial Sequence
  VP8* aa64-223short P[6] SP(HLA-A2)
MAVMAPRTLVLLLSGALALTQTWAVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 763 - protein, 201 aa, Artificial Sequence
  VP8* aa64-223short P[4] SP(TPA)+P2+Linker
MDAMKRGLCCVLLLCGAVFVSQYIKANSKFIGITELGSGSGVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 764 - protein, 201 aa, Artificial Sequence
  VP8* aa64-223short P[6] SP(TPA)+P2+Linker
MDAMKRGLCCVLLLCGAVFVSQYIKANSKFIGITELGSGSGVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 765 - protein, 198 aa, Artificial Sequence
  VP8* aa64-223short P[4] SP(HSA)+P2+Linker
MKWVTFISLLFLFSSAYSQYIKANSKFIGITELGSGSGVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 766 - protein, 198 aa, Artificial Sequence
  VP8* aa64-223short P[6] SP(HSA)+P2+Linker
MKWVTFISLLFLFSSAYSQYIKANSKFIGITELGSGSGVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 767 - protein, 198 aa, Artificial Sequence
  VP8* aa64-223short P[4] SP(IgE)+P2+Linker
MDWTWILFLVAAATRVHSQYIKANSKFIGITELGSGSGVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 768 - protein, 198 aa, Artificial Sequence
  VP8* aa64-223short P[6] SP(IgE)+P2+Linker
MDWTWILFLVAAATRVHSQYIKANSKFIGITELGSGSGVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 769 - protein, 204 aa, Artificial Sequence
  VP8* aa64-223short P[4] SP(CD5)+P2+Linker
MPMGSLQPLATLYLLGMLVASCLGQYIKANSKFIGITELGSGSGVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 770 - protein, 204 aa, Artificial Sequence
  VP8* aa64-223short P[6] SP(CD5)+P2+Linker
MPMGSLQPLATLYLLGMLVASCLGQYIKANSKFIGITELGSGSGVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 771 - protein, 204 aa, Artificial Sequence
  VP8* aa64-223short P[4] SP(HLA-A2)+P2+Linker
MAVMAPRTLVLLLSGALALTQTWAQYIKANSKFIGITELGSGSGVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 772 - protein, 204 aa, Artificial Sequence
  VP8* aa64-223short P[6] SP(HLA-A2)+P2+Linker
MAVMAPRTLVLLLSGALALTQTWAQYIKANSKFIGITELGSGSGVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 773 - protein, 161 aa, Artificial Sequence
  VP8* aa64-223short P[4] w/o glyco
MVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 774 - protein, 161 aa, Artificial Sequence
  VP8* aa64-223short P[6] w/o glyco
MVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 775 - protein, 181 aa, Artificial Sequence
  VP8* aa64-223short P[4] P2+Linker w/o glyco
MQYIKANSKFIGITELGSGSGVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 776 - protein, 181 aa, Artificial Sequence
  VP8* aa64-223short P[6] P2+Linker w/o glyco
MQYIKANSKFIGITELGSGSGVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 777 - protein, 181 aa, Artificial Sequence
  VP8* aa64-223short P[4] SP(TPA) w/o glyco
MDAMKRGLCCVLLLCGAVFVSVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 778 - protein, 181 aa, Artificial Sequence
  VP8* aa64-223short P[6] SP(TPA) w/o glyco
MDAMKRGLCCVLLLCGAVFVSVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 779 - protein, 178 aa, Artificial Sequence
  VP8* aa64-223short P[4] SP(HSA) w/o glyco
MKWVTFISLLFLFSSAYSVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 780 - protein, 178 aa, Artificial Sequence
  VP8* aa64-223short P[6] SP(HSA) w/o glyco
MKWVTFISLLFLFSSAYSVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 781 - protein, 178 aa, Artificial Sequence
  VP8* aa64-223short P[4] SP(IgE) w/o glyco
MDWTWILFLVAAATRVHSVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 782 - protein, 178 aa, Artificial Sequence
  VP8* aa64-223short P[6] SP(IgE) w/o glyco
MDWTWILFLVAAATRVHSVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 783 - protein, 184 aa, Artificial Sequence
  VP8* aa64-223short P[4] SP(CD5) w/o glyco
MPMGSLQPLATLYLLGMLVASCLGVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 784 - protein, 184 aa, Artificial Sequence
  VP8* aa64-223short P[6] SP(CD5) w/o glyco
MPMGSLQPLATLYLLGMLVASCLGVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 785 - protein, 184 aa, Artificial Sequence
  VP8* aa64-223short P[4] SP(HLA-A2) w/o glyco
MAVMAPRTLVLLLSGALALTQTWAVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 786 - protein, 184 aa, Artificial Sequence
  VP8* aa64-223short P[6] SP(HLA-A2) w/o glyco
MAVMAPRTLVLLLSGALALTQTWAVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 787 - protein, 201 aa, Artificial Sequence
  VP8* aa64-223short P[4] SP(TPA)+P2+Linker w/o glyco
MDAMKRGLCCVLLLCGAVFVSQYIKANSKFIGITELGSGSGVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 788 - protein, 201 aa, Artificial Sequence
  VP8* aa64-223short P[6] SP(TPA)+P2+Linker w/o glyco
MDAMKRGLCCVLLLCGAVFVSQYIKANSKFIGITELGSGSGVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 789 - protein, 198 aa, Artificial Sequence
  VP8* aa64-223short P[4] SP(HSA)+P2+Linker w/o glyco
MKWVTFISLLFLFSSAYSQYIKANSKFIGITELGSGSGVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 790 - protein, 198 aa, Artificial Sequence
  VP8* aa64-223short P[6] SP(HSA)+P2+Linker w/o glyco
MKWVTFISLLFLFSSAYSQYIKANSKFIGITELGSGSGVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 791 - protein, 198 aa, Artificial Sequence
  VP8* aa64-223short P[4] SP(IgE)+P2+Linker w/o glyco
MDWTWILFLVAAATRVHSQYIKANSKFIGITELGSGSGVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 792 - protein, 198 aa, Artificial Sequence
  VP8* aa64-223short P[6] SP(IgE)+P2+Linker w/o glyco
MDWTWILFLVAAATRVHSQYIKANSKFIGITELGSGSGVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 793 - protein, 204 aa, Artificial Sequence
  VP8* aa64-223short P[4] SP(CD5)+P2+Linker w/o glyco
MPMGSLQPLATLYLLGMLVASCLGQYIKANSKFIGITELGSGSGVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 794 - protein, 204 aa, Artificial Sequence
  VP8* aa64-223short P[6] SP(CD5)+P2+Linker w/o glyco
MPMGSLQPLATLYLLGMLVASCLGQYIKANSKFIGITELGSGSGVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 795 - protein, 204 aa, Artificial Sequence
  VP8* aa64-223short P[4] SP(HLA-A2)+P2+Linker w/o glyco
MAVMAPRTLVLLLSGALALTQTWAQYIKANSKFIGITELGSGSGVLDGPYQPTTFKPPNDYWLLISSNTDGVVYESTQNSDFWTAVIAVEPHVQQTNRQYVLFGENKQFNIEQSSDKWKFFEMFKGNSQSDFSNRRTLTSSNRLVGMLKYGGRVWTFHGETPRATTDSSSTADLNQISIIIHSEFYIIPRSQESKCNEYINQGL

SEQ ID NO: 796 - protein, 204 aa, Artificial Sequence
  VP8* aa64-223short P[6] SP(HLA-A2)+P2+Linker w/o glyco
MAVMAPRTLVLLLSGALALTQTWAQYIKANSKFIGITELGSGSGVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGL

SEQ ID NO: 797 - protein, 255 aa, Artificial Sequence
  P2 VP8* P[4]-long
MQYIKANSKFIGITELASLIYRQLLTNSYSVDLHDEIEQIGSEKTQNVTVNPGPFAQTRYAPVNWGHGEINDSTTVEPVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGLPPIQNTRNVVPLSLSSR

SEQ ID NO: 798 - protein, 255 aa, Artificial Sequence
  P2 VP8* P[6]-long
MQYIKANSKFIGITELASLIYRQLLTNSYTVELSDEINTIGSEKNQNVTINPGPFAQTNYAPVTWSHGEVNDSTTIEPVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 799 - protein, 255 aa, Artificial Sequence
  P2 VP8* P[8]-long
MQYIKANSKFIGITELASLIYRQLLTNSYSVDLHDEIEQIGSEKTQNVTVNPGPFAQTRYAPVNWGHGEINDSTTVEPILDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 800 - protein, 176 aa, Artificial Sequence
  P2 VP8* P[4]-short
MQYIKANSKFIGITELVLDGPYQPTTFKPPNDYWLLISSNTDGVVYESTNNSDFWTAVIAVEPHVNQTNRQYVLFGENKQFNIENSSDKWKFFEMFKGNSQSDFSNRRTLTSSNRLVGMLKYGGRVWTFHGETPRATTDSSSTADLNNISIIIHSEFYIIPRSQESKCNEYINNGL

SEQ ID NO: 801 - protein, 176 aa, Artificial Sequence
  P2 VP8* P[6]-short
MQYIKANSKFIGITELVLDGPYQPTNFKPPNDYWILLNPTNQQVVLEGTNKTDIWVALLLVEPNVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 802 - protein, 175 aa, Artificial Sequence
  P2 VP8* P[8]-short
MQYIKANSKFIGITELLDGPYQPTTFTPPTDYWILITSNTNGVVYESTNNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 803 - protein, 175 aa, Artificial Sequence
  P2 VP8* P[8]-WA-VirWa-short
MQYIKANSKFIGITELLDGPYQPTTFTPPNDYWILINSNTNGVVYESTNNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNNISITIHSEFYIIPRSQESKCNEYINNGL

SEQ ID NO: 804 - protein, 275 aa, Artificial Sequence
  SP P2 VP8* P[4]-long w/o glyco
MDAMKRGLCCVLLLCGAVFVSQYIKANSKFIGITELASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGLPPIQNTRNVVPLSLSSR

SEQ ID NO: 805 - protein, 275 aa, Artificial Sequence
  SP P2 VP8* P[6]-long w/o glyco
MDAMKRGLCCVLLLCGAVFVSQYIKANSKFIGITELASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 806 - protein, 275 aa, Artificial Sequence
  SP P2 VP8* P[8]-long w/o glyco
MDAMKRGLCCVLLLCGAVFVSQYIKANSKFIGITELASLIYRQLLTNSYSVDLHDEIEQIGSEKTQQVTVNPGPFAQTRYAPVNWGHGEIQDSTTVEPILDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 807 - protein, 196 aa, Artificial Sequence
  SP P2 VP8* P[4]-short w/o glyco
MDAMKRGLCCVLLLCGAVFVSQYIKANSKFIGITELVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGL

SEQ ID NO: 808 - protein, 196 aa, Artificial Sequence
  SP P2 VP8* P[6]-short w/o glyco
MDAMKRGLCCVLLLCGAVFVSQYIKANSKFIGITELVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 809 - protein, 195 aa, Artificial Sequence
  SP P2 VP8* P[8]-short w/o glyco
MDAMKRGLCCVLLLCGAVFVSQYIKANSKFIGITELLDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 810 - protein, 195 aa, Artificial Sequence
  SP P2 VP8* P[8]-WA-VirWa-short w/o glyco
MDAMKRGLCCVLLLCGAVFVSQYIKANSKFIGITELLDGPYQPTTFTPPNDYWILINSNTNGVVYESTQNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNQISITIHSEFYIIPRSQESKCNEYINNGL

SEQ ID NO: 811 - protein, 321 aa, Artificial Sequence
  SP P2 VP8* P[4]-long w/o glyco w TM domain
MDAMKRGLCCVLLLCGAVFVSQYIKANSKFIGITELASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGLPPIQNTRNVVPLSLSSRKLESTRIYQILAIYSTVASSLVLVVSLGAISFWMCSNGSLQCRICI

SEQ ID NO: 812 - protein, 321 aa, Artificial Sequence
  SP P2 VP8* P[6]-long w/o glyco w TM domain
MDAMKRGLCCVLLLCGAVFVSQYIKANSKFIGITELASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSRKLESTRIYQILAIYSTVASSLVLVVSLGAISFWMCSNGSLQCRICI

SEQ ID NO: 813 - protein, 321 aa, Artificial Sequence
  SP P2 VP8* P[8]-long w/o glyco w TM domain
MDAMKRGLCCVLLLCGAVFVSQYIKANSKFIGITELASLIYRQLLTNSYSVDLHDEIEQIGSEKTQQVTVNPGPFAQTRYAPVNWGHGEIQDSTTVEPILDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSRKLESTRIYQILAIYSTVASSLVLVVSLGAISFWMCSNGSLQCRICI

SEQ ID NO: 814 - protein, 242 aa, Artificial Sequence
  SP P2 VP8* P[4]-short w/o glyco w TM domain
MDAMKRGLCCVLLLCGAVFVSQYIKANSKFIGITELVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGLKLESTRIYQILAIYSTVASSLVLVVSLGAISFWMCSNGSLQCRICI

SEQ ID NO: 815 - protein, 242 aa, Artificial Sequence
  SP P2 VP8* P[6]-short w/o glyco w TM domain
MDAMKRGLCCVLLLCGAVFVSQYIKANSKFIGITELVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLKLESTRIYQILAIYSTVASSLVLVVSLGAISFWMCSNGSLQCRICI

SEQ ID NO: 816 - protein, 241 aa, Artificial Sequence
  SP P2 VP8* P[8]-short w/o glyco w TM domain
MDAMKRGLCCVLLLCGAVFVSQYIKANSKFIGITELLDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLKLESTRIYQILAIYSTVASSLVLVVSLGAISFWMCSNGSLQCRICI

SEQ ID NO: 817 - protein, 241 aa, Artificial Sequence
  SP P2 VP8* P[8]-WA-VirWa-short w/o glyco w TM domain
MDAMKRGLCCVLLLCGAVFVSQYIKANSKFIGITELLDGPYQPTTFTPPNDYWILINSNTNGVVYESTQNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNQISITIHSEFYIIPRSQESKCNEYINNGLKLESTRIYQILAIYSTVASSLVLVVSLGAISFWMCSNGSLQCRICI

SEQ ID NO: 818 - protein, 433 aa, Artificial Sequence
  SP VLP peptide linker P2 VP8* P[4]-long w/o glyco
MDAMKRGLCCVLLLCGAVFVSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVICGGGGSGGGGQYIKANSKFIGITELASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGLPPIQNTRNVVPLSLSSR

SEQ ID NO: 819 - protein, 433 aa, Artificial Sequence
  SP VLP peptide linker P2 VP8* P[6]-long w/o glyco
MDAMKRGLCCVLLLCGAVFVSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVICGGGGSGGGGQYIKANSKFIGITELASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 820 - protein, 433 aa, Artificial Sequence
  SP VLP peptide linker P2 VP8* P[8]-long w/o glyco
MDAMKRGLCCVLLLCGAVFVSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVICGGGGSGGGGQYIKANSKFIGITELASLIYRQLLTNSYSVDLHDEIEQIGSEKTQQVTVNPGPFAQTRYAPVNWGHGEIQDSTTVEPILDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 821 - protein, 354 aa, Artificial Sequence
  SP VLP peptide linker P2 VP8* P[4]-short w/o glyco
MDAMKRGLCCVLLLCGAVFVSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVICGGGGSGGGGQYIKANSKFIGITELVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGL

SEQ ID NO: 822 - protein, 354 aa, Artificial Sequence
  SP VLP peptide linker P2 VP8* P[6]-short w/o glyco
MDAMKRGLCCVLLLCGAVFVSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVICGGGGSGGGGQYIKANSKFIGITELVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGL

SEQ ID NO: 823 - protein, 353 aa, Artificial Sequence
  SP VLP peptide linker P2 VP8* P[8]-short w/o glyco
MDAMKRGLCCVLLLCGAVFVSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVICGGGGSGGGGQYIKANSKFIGITELLDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGL

SEQ ID NO: 824 - protein, 353 aa, Artificial Sequence
  SP VLP peptide linker P2 VP8* P[8]-Wa-VirWa-short w/o glyco
MDAMKRGLCCVLLLCGAVFVSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVICGGGGSGGGGQYIKANSKFIGITELLDGPYQPTTFTPPNDYWILINSNTNGVVYESTQNSDFWTAVVAIEPHVNPVDRQYTIFGESKQFNVRNDSNKWKFLEMFRSSSQNEFYNRRTLTSDTRLVGILKYGGRVWTFHGETPRATTDSSSTANLNQISITIHSEFYIIPRSQESKCNEYINNGL

SEQ ID NO: 825 - protein, 1037 aa, Artificial Sequence
  SP 4x(P2 VP8* P[4]-long w/o glyco)
MDAMKRGLCCVLLLCGAVFVSQYIKANSKFIGITELASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGLPPIQNTRNVVPLSLSSRQYIKANSKFIGITELASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGLPPIQNTRNVVPLSLSSRQYIKANSKFIGITELASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGLPPIQNTRNVVPLSLSSRQYIKANSKFIGITELASLIYRQLLTNSYSVDLHDEIEQIGSEKTQQVTVNPGPFAQTRYAPVNWGHGEIQDSTTVEPVLDGPYQPTTFKPPNDYWLLISSNTDGVVYESTQNSDFWTAVIAVEPHVQQTNRQYVLFGENKQFNIENSSDKWKFFEMFKGNSQSDFSNRRTLTSSNRLVGMLKYGGRVWTFHGETPRATTDSSSTADLNQISIIIHSEFYIIPRSQESKCNEYINNGLPPIQNTRNVVPLSLSSR

SEQ ID NO: 826 - protein, 1037 aa, Artificial Sequence
  SP 4x(P2 VP8* P[6]-long w/o glyco)
MDAMKRGLCCVLLLCGAVFVSQYIKANSKFIGITELASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSRQYIKANSKFIGITELASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSRQYIKANSKFIGITELASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSRQYIKANSKFIGITELASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTNQSRQYTLFGETKQITVENNTNKWKFFEMFRSSVSAEFQHKRTLTSDTKLAGFMKFYNSVWTFHGETPNATTDYSSTSNLFEVETVIHVEFYIIPRSQESKCSEYINTGLPPMQNTRNIVPVALSSR

SEQ ID NO: 827 - protein, 1037 aa, Artificial Sequence
  SP 4x(P2 VP8* P[8]-long w/o glyco)
MDAMKRGLCCVLLLCGAVFVSQYIKANSKFIGITELASLIYRQLLTNSYSVDLHDEIEQIGSEKTQQVTVNPGPFAQTRYAPVNWGHGEIQDSTTVEPILDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSRQYIKANSKFIGITELASLIYRQLLTNSYSVDLHDEIEQIGSEKTQQVTVNPGPFAQTRYAPVNWGHGEIQDSTTVEPILDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSRQYIKANSKFIGITELASLIYRQLLTNSYSVDLHDEIEQIGSEKTQQVTVNPGPFAQTRYAPVNWGHGEIQDSTTVEPILDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSRQYIKANSKFIGITELASLIYRQLLTNSYSVDLHDEIEQIGSEKTQQVTVNPGPFAQTRYAPVNWGHGEIQDSTTVEPILDGPYQPTTFTPPTDYWILITSNTNGVVYESTQNSDFWTAVIAVEPHVNPVDRQYNVFGENKQFNVRNDSDKWKFLEMFRGSSQNDFYNRRTLTSDTRLVGILKYGGRVWTFHGETPRATTDSSNTANLDGISITIHSEFYIIPRSQESKCNEYINNGLPPIQNTRNVVPLSLSSR

SEQ ID NO: 828 - RNA, 723 nt, Artificial Sequence
  VP8* aa2-240 long P[4]
auggcuucgcucauuuauagacaacuucucacuaacucauauucgguagacuugcaugacgaaauagaacagauuggaucggagaaaacucaaaaugugacaguaaauccagguccauuugcacagacuagauaugcuccagucaauuggggacacggagagauuaaugauucaacuacaguggaaccaguuuuagaugguccuuaucaaccaacuacauuuaaaccacccaaugauuauuggcugcuuauuaguucgaauacagauggaguagucuaugagaguacaaauaauagugacuuuuggacagcggucauugcugucgaaccacaugucaaucaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaauaauauaucaauuauaauucauucagaguuuuauauuauuccaagaucccaagaaucuaaauguaaugaauauaucaauaaugguuuaccaccaauucaaaauacuagaaauguaguuccauuaucucuaucauccagguga

SEQ ID NO: 829 - RNA, 723 nt, Artificial Sequence
  VP8* aa2-240 long P[6]
auggcuucgcucauuuauagacagcuacucacuaauucauacacaguagaauuaucagaugaaaucaauacaauuggaucagaaaaaaaucagaauguaacgauuaaucccggaccguuugcucaaacaaauuaugcaccagugacuuggagucauggggaagugaaugauucgacaacaauagagccaguacucgaugguccuuaucaaccaacaaauuuuaagccaccaaacgauuacuggauauuauugaauccaacuaaucaacaaguuguauuagaagguaccaauaaaacugauaucuggguugcuuuauuacuuguugaaccaaacguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagauga

SEQ ID NO: 830 - RNA, 723 nt, Artificial Sequence
  VP8* aa2-240 long P[8]
auggcuucgcucauuuauagacagcuucucacuaauucauauucaguagauuuacaugaugaaauagaacaaauuggaucagaaaaaacucaaaauguaacuguaaauccagguccauuugcucaaacgagauaugcuccaguuaauuggggucauggagaaauaaaugauucaacgacaguggaaccaauuuuagaugguccuuaucaaccuacuacauuuacaccaccuacugauuauuggauacuuauuaccucaaauacaaauggaguaguauacgagaguacaaauaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagauga

SEQ ID NO: 831 - RNA, 723 nt, Artificial Sequence
  VP8* aa2-240 long P[8]-VirWa
auggcuucgcucauuuauagacagcuucucacuaauucauauucaguagauuuacaugaugaaauagagcaaauuggaucagaaaaaacucaaaauguaacuauaaauccgaguccauuugcacagacuagauaugcuccagucaauuggggucauggagagauaaaugauucgacuacaguagaaccaauuuuagaugguccuuaucagccaacuacauuuacuccaccuaaugauuauuggauacuuauuaauucaaauacaaauggaguaguauaugaaaguacaaauaauagugacuuuuggacugcagucguugcuauugaaccgcacguuaacccaguagauagacaauauacgauauuuggugaaaguaagcaauuuaaugugcguaacgauucaaauaaauggaaguuuuuagaaauguuuagaagcaguagucaaaaugaauuuuauaauagacguacauuaacuucugauacuagacuuguaggaauauugaaauaugguggaagaguauggacauuucauggugaaacaccaagagcuacuacugacaguucaaguacugcaaauuuaaauaauauaucaauuacaauucauucagaauuuuacauuauuccaaggucccaagaaucuaaauguaaugaauauauuaauaauggucugccaccaauucaaaauacuagaaauguaguuccauugccauuaucaucuagauga

SEQ ID NO: 832 - RNA, 486 nt, Artificial Sequence
  VP8* aa64-223 short P[4]
augguuuuagaugguccuuaucaaccaacuacauuuaaaccacccaaugauuauuggcugcuuauuaguucgaauacagauggaguagucuaugagaguacaaauaauagugacuuuuggacagcggucauugcugucgaaccacaugucaaucaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaauaauauaucaauuauaauucauucagaguuuuauauuauuccaagaucccaagaaucuaaauguaaugaauauaucaauaaugguuuauga

SEQ ID NO: 833 - RNA, 483 nt, Artificial Sequence
  VP8* aa65-223 short P[4]
auguuagaugguccuuaucaaccaacuacauuuaaaccacccaaugauuauuggcugcuuauuaguucgaauacagauggaguagucuaugagaguacaaauaauagugacuuuuggacagcggucauugcugucgaaccacaugucaaucaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaauaauauaucaauuauaauucauucagaguuuuauauuauuccaagaucccaagaaucuaaauguaaugaauauaucaauaaugguuuauga

SEQ ID NO: 834 - RNA, 486 nt, Artificial Sequence
  VP8* aa64-223 short P[6]
augguacucgaugguccuuaucaaccaacaaauuuuaagccaccaaacgauuacuggauauuauugaauccaacuaaucaacaaguuguauuagaagguaccaauaaaacugauaucuggguugcuuuauuacuuguugaaccaaacguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuauga

SEQ ID NO: 835 - RNA, 483 nt, Artificial Sequence
  VP8* aa65-223 short P[6]
augcucgaugguccuuaucaaccaacaaauuuuaagccaccaaacgauuacuggauauuauugaauccaacuaaucaacaaguuguauuagaagguaccaauaaaacugauaucuggguugcuuuauuacuuguugaaccaaacguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuauga

SEQ ID NO: 836 - RNA, 483 nt, Artificial Sequence
  VP8* aa65-223 short P[8]
auguuagaugguccuuaucaaccuacuacauuuacaccaccuacugauuauuggauacuuauuaccucaaauacaaauggaguaguauacgagaguacaaauaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucuguga

SEQ ID NO: 837 - RNA, 483 nt, Artificial Sequence
  VP8* aa65-223 short P[8]-VirWa
auguuagaugguccuuaucagccaacuacauuuacuccaccuaaugauuauuggauacuuauuaauucaaauacaaauggaguaguauaugaaaguacaaauaauagugacuuuuggacugcagucguugcuauugaaccgcacguuaacccaguagauagacaauauacgauauuuggugaaaguaagcaauuuaaugugcguaacgauucaaauaaauggaaguuuuuagaaauguuuagaagcaguagucaaaaugaauuuuauaauagacguacauuaacuucugauacuagacuuguaggaauauugaaauaugguggaagaguauggacauuucauggugaaacaccaagagcuacuacugacaguucaaguacugcaaauuuaaauaauauaucaauuacaauucauucagaauuuuacauuauuccaaggucccaagaaucuaaauguaaugaauauauuaauaauggucuguga

SEQ ID NO: 838 - RNA, 768 nt, Artificial Sequence
  P2 VP8* P[4]-long CDS wt
augcaguauauaaaagcaaauucuaaauuuauagguauaacugaacuagcuucgcucauuuauagacaacuucucacuaacucauauucgguagacuugcaugacgaaauagaacagauuggaucggagaaaacucaaaaugugacaguaaauccagguccauuugcacagacuagauaugcuccagucaauuggggacacggagagauuaaugauucaacuacaguggaaccaguuuuagaugguccuuaucaaccaacuacauuuaaaccacccaaugauuauuggcugcuuauuaguucgaauacagauggaguagucuaugagaguacaaauaauagugacuuuuggacagcggucauugcugucgaaccacaugucaaucaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaauaauauaucaauuauaauucauucagaguuuuauauuauuccaagaucccaagaaucuaaauguaaugaauauaucaauaaugguuuaccaccaauucaaaauacuagaaauguaguuccauuaucucuaucauccagguga

SEQ ID NO: 839 - RNA, 768 nt, Artificial Sequence
  P2 VP8* P[6]-long CDS wt
augcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagaauguaacgauuaaucccggaccguuugcucaaacaaauuaugcaccagugacuuggagucauggggaagugaaugauucgacaacaauagagccaguacucgaugguccuuaucaaccaacaaauuuuaagccaccaaacgauuacuggauauuauugaauccaacuaaucaacaaguuguauuagaagguaccaauaaaacugauaucuggguugcuuuauuacuuguugaaccaaacguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagauga

SEQ ID NO: 840 - RNA, 768 nt, Artificial Sequence
  P2 VP8* P[8]-long CDS wt
augcaguauauaaaagcaaauucuaaauuuauagguauaacugaacuagcuucgcucauuuauagacagcuucucacuaauucauauucaguagauuuacaugaugaaauagaacaaauuggaucagaaaaaacucaaaauguaacuguaaauccagguccauuugcucaaacgagauaugcuccaguuaauuggggucauggagaaauaaaugauucaacgacaguggaaccaauuuuagaugguccuuaucaaccuacuacauuuacaccaccuacugauuauuggauacuuauuaccucaaauacaaauggaguaguauacgagaguacaaauaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagauga

SEQ ID NO: 841 - RNA, 531 nt, Artificial Sequence
  P2 VP8* P[4]-short CDS wt
augcaguauauaaaagcaaauucuaaauuuauagguauaacugaacuaguuuuagaugguccuuaucaaccaacuacauuuaaaccacccaaugauuauuggcugcuuauuaguucgaauacagauggaguagucuaugagaguacaaauaauagugacuuuuggacagcggucauugcugucgaaccacaugucaaucaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaauaauauaucaauuauaauucauucagaguuuuauauuauuccaagaucccaagaaucuaaauguaaugaauauaucaauaaugguuuauga

SEQ ID NO: 842 - RNA, 531 nt, Artificial Sequence
  P2 VP8* P[6]-short CDS wt
augcaguauauaaaagcaaauucuaaauuuauagguauaacugaacuaguacucgaugguccuuaucaaccaacaaauuuuaagccaccaaacgauuacuggauauuauugaauccaacuaaucaacaaguuguauuagaagguaccaauaaaacugauaucuggguugcuuuauuacuuguugaaccaaacguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuauga

SEQ ID NO: 843 - RNA, 528 nt, Artificial Sequence
  P2 VP8* P[8]-short CDS wt
augcaguauauaaaagcaaauucuaaauuuauagguauaacugaacuauuagaugguccuuaucaaccuacuacauuuacaccaccuacugauuauuggauacuuauuaccucaaauacaaauggaguaguauacgagaguacaaauaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucuguga

SEQ ID NO: 844 - RNA, 528 nt, Artificial Sequence
  P2 VP8* P[8]-WA-VirWa-short CDS wt
augcaguauauaaaagcaaauucuaaauuuauagguauaacugaacuauuagaugguccuuaucagccaacuacauuuacuccaccuaaugauuauuggauacuuauuaauucaaauacaaauggaguaguauaugaaaguacaaauaauagugacuuuuggacugcagucguugcuauugaaccgcacguuaacccaguagauagacaauauacgauauuuggugaaaguaagcaauuuaaugugcguaacgauucaaauaaauggaaguuuuuagaaauguuuagaagcaguagucaaaaugaauuuuauaauagacguacauuaacuucugauacuagacuuguaggaauauugaaauaugguggaagaguauggacauuucauggugaaacaccaagagcuacuacugacaguucaaguacugcaaauuuaaauaauauaucaauuacaauucauucagaauuuuacauuauuccaaggucccaagaaucuaaauguaaugaauauauuaauaauggucuguga

SEQ ID NO: 845 - RNA, 828 nt, Artificial Sequence
  SP P2 VP8* P[4]-long w/o glyco CDS wt
auggaugcaaugaagagagggcucugcugugugcugcugcuguguggagcagucuucguuucgcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccagguga

SEQ ID NO: 846 - RNA, 828 nt, Artificial Sequence
  SP P2 VP8* P[6]-long w/o glyco CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagauga

SEQ ID NO: 847 - RNA, 828 nt, Artificial Sequence
  SP P2 VP8* P[8]-long w/o glyco CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagauga

SEQ ID NO: 848 - RNA, 591 nt, Artificial Sequence
  SP P2 VP8* P[4]-short w/o glyco CDS wt
auggaugcaaugaagagagggcucugcugugugcugcugcuguguggagcagucuucguuucgcaguauauaaaagcaaauucuaaauuuauagguauaacugaacuaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuauga

SEQ ID NO: 849 - RNA, 591 nt, Artificial Sequence
  SP P2 VP8* P[6]-short w/o glyco CDS wt
auggaugcaaugaagagagggcucugcugugugcugcugcuguguggagcagucuucguuucgcaguauauaaaagcaaauucuaaauuuauagguauaacugaacuaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuauga

SEQ ID NO: 850 - RNA, 588 nt, Artificial Sequence
  SP P2 VP8* P[8]-short w/o glyco CDS wt
auggaugcaaugaagagagggcucugcugugugcugcugcuguguggagcagucuucguuucgcaguauauaaaagcaaauucuaaauuuauagguauaacugaacuauuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucuguga

SEQ ID NO: 851 - RNA, 588 nt, Artificial Sequence
  SP P2 VP8* P[8]-WA-VirWa-short w/o glyco CDS wt
auggaugcaaugaagagagggcucugcugugugcugcugcuguguggagcagucuucguuucgcaguauauaaaagcaaauucuaaauuuauagguauaacugaacuauuagaugguccuuaucagccaacuacauuuacuccaccuaaugauuauuggauacuuauuaauucaaauacaaauggaguaguauaugaaaguacacagaauagugacuuuuggacugcagucguugcuauugaaccgcacguuaacccaguagauagacaauauacgauauuuggugaaaguaagcaauuuaaugugcguaacgauucaaauaaauggaaguuuuuagaaauguuuagaagcaguagucaaaaugaauuuuauaauagacguacauuaacuucugauacuagacuuguaggaauauugaaauaugguggaagaguauggacauuucauggugaaacaccaagagcuacuacugacaguucaaguacugcaaauuuaaaucagauaucaauuacaauucauucagaauuuuacauuauuccaaggucccaagaaucuaaauguaaugaauauauuaauaauggucuguga

SEQ ID NO: 852 - RNA, 966 nt, Artificial Sequence
  SP P2 VP8* P[4]-long w/o glyco w TM domain CDS wt
auggaugcaaugaagagagggcucugcugugugcugcugcuguguggagcagucuucguuucgcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccaggaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 853 - RNA, 966 nt, Artificial Sequence
  SP P2 VP8* P[6]-long w/o glyco w TM domain CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 854 - RNA, 966 nt, Artificial Sequence
  SP P2 VP8* P[8]-long w/o glyco w TM domain CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 855 - RNA, 729 nt, Artificial Sequence
  SP P2 VP8* P[4]-short w/o glyco w TM domain CDS wt
auggaugcaaugaagagagggcucugcugugugcugcugcuguguggagcagucuucguuucgcaguauauaaaagcaaauucuaaauuuauagguauaacugaacuaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 856 - RNA, 729 nt, Artificial Sequence
  SP P2 VP8* P[6]-short w/o glyco w TM domain CDS wt
auggaugcaaugaagagagggcucugcugugugcugcugcuguguggagcagucuucguuucgcaguauauaaaagcaaauucuaaauuuauagguauaacugaacuaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 857 - RNA, 726 nt, Artificial Sequence
  SP P2 VP8* P[8]-short w/o glyco w TM domain CDS wt
auggaugcaaugaagagagggcucugcugugugcugcugcuguguggagcagucuucguuucgcaguauauaaaagcaaauucuaaauuuauagguauaacugaacuauuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 858 - RNA, 726 nt, Artificial Sequence
  SP P2 VP8* P[8]-WA-VirWa-short w/o glyco w TM domain CDS wt
auggaugcaaugaagagagggcucugcugugugcugcugcuguguggagcagucuucguuucgcaguauauaaaagcaaauucuaaauuuauagguauaacugaacuauuagaugguccuuaucagccaacuacauuuacuccaccuaaugauuauuggauacuuauuaauucaaauacaaauggaguaguauaugaaaguacacagaauagugacuuuuggacugcagucguugcuauugaaccgcacguuaacccaguagauagacaauauacgauauuuggugaaaguaagcaauuuaaugugcguaacgauucaaauaaauggaaguuuuuagaaauguuuagaagcaguagucaaaaugaauuuuauaauagacguacauuaacuucugauacuagacuuguaggaauauugaaauaugguggaagaguauggacauuucauggugaaacaccaagagcuacuacugacaguucaaguacugcaaauuuaaaucagauaucaauuacaauucauucagaauuuuacauuauuccaaggucccaagaaucuaaauguaaugaauauauuaauaauggucugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 859 - RNA, 1302 nt, Artificial Sequence
  SP VLP peptide linker P2 VP8* P[4]-long w/o glyco CDS wt
auggaugcaaugaagagagggcucugcugugugcugcugcuguguggagcagucuucguuucggacauagaucccuauaaagaauuugguucaucuuaucaguuguugaauuuucuuccuuuggacuucuuuccugaccuuaaugcuuugguggacacugcuacugccuuguaugaagaagagcuaacagguagggaacauugcucuccgcaccauacagcuauuagacaagcuuuaguaugcugggaugaauuaacuaaauugauagcuuggaugagcucuaacauaacuucugaacaaguaagaacaaucauaguaaaucaugucaaugauaccuggggacuuaaggugagacaaaguuuaugguuucauuugucaugucucacuuuuggacaacauacaguucaagaauuuuuaguaaguuuuggaguauggaucagaacuccagcuccauauagaccuccuaaugcacccauucucucgacucuuccggaacauacagucauuuguggcggcggcggcuccggcggcggcggccaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccagguga

SEQ ID NO: 860 - RNA, 1302 nt, Artificial Sequence
  SP VLP peptide linker P2 VP8* P[6]-long w/o glyco CDS wt
auggaugcaaugaagagagggcucugcugugugcugcugcuguguggagcagucuucguuucggacauagaucccuauaaagaauuugguucaucuuaucaguuguugaauuuucuuccuuuggacuucuuuccugaccuuaaugcuuugguggacacugcuacugccuuguaugaagaagagcuaacagguagggaacauugcucuccgcaccauacagcuauuagacaagcuuuaguaugcugggaugaauuaacuaaauugauagcuuggaugagcucuaacauaacuucugaacaaguaagaacaaucauaguaaaucaugucaaugauaccuggggacuuaaggugagacaaaguuuaugguuucauuugucaugucucacuuuuggacaacauacaguucaagaauuuuuaguaaguuuuggaguauggaucagaacuccagcuccauauagaccuccuaaugcacccauucucucgacucuuccggaacauacagucauuuguggcggcggcggcuccggcggcggcggccaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagauga

SEQ ID NO: 861 - RNA, 1302 nt, Artificial Sequence
  SP VLP peptide linker P2 VP8* P[8]-long w/o glyco CDS wt
auggaugcaaugaagagagggcucugcugugugcugcugcuguguggagcagucuucguuucggacauagaucccuauaaagaauuugguucaucuuaucaguuguugaauuuucuuccuuuggacuucuuuccugaccuuaaugcuuugguggacacugcuacugccuuguaugaagaagagcuaacagguagggaacauugcucuccgcaccauacagcuauuagacaagcuuuaguaugcugggaugaauuaacuaaauugauagcuuggaugagcucuaacauaacuucugaacaaguaagaacaaucauaguaaaucaugucaaugauaccuggggacuuaaggugagacaaaguuuaugguuucauuugucaugucucacuuuuggacaacauacaguucaagaauuuuuaguaaguuuuggaguauggaucagaacuccagcuccauauagaccuccuaaugcacccauucucucgacucuuccggaacauacagucauuuguggcggcggcggcuccggcggcggcggccaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagauga

SEQ ID NO: 862 - RNA, 1065 nt, Artificial Sequence
  SP VLP peptide linker P2 VP8* P[4]-short w/o glyco CDS wt
auggaugcaaugaagagagggcucugcugugugcugcugcuguguggagcagucuucguuucggacauagaucccuauaaagaauuugguucaucuuaucaguuguugaauuuucuuccuuuggacuucuuuccugaccuuaaugcuuugguggacacugcuacugccuuguaugaagaagagcuaacagguagggaacauugcucuccgcaccauacagcuauuagacaagcuuuaguaugcugggaugaauuaacuaaauugauagcuuggaugagcucuaacauaacuucugaacaaguaagaacaaucauaguaaaucaugucaaugauaccuggggacuuaaggugagacaaaguuuaugguuucauuugucaugucucacuuuuggacaacauacaguucaagaauuuuuaguaaguuuuggaguauggaucagaacuccagcuccauauagaccuccuaaugcacccauucucucgacucuuccggaacauacagucauuuguggcggcggcggcuccggcggcggcggccaguauauaaaagcaaauucuaaauuuauagguauaacugaacuaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuauga

SEQ ID NO: 863 - RNA, 1065 nt, Artificial Sequence
  SP VLP peptide linker P2 VP8* P[6]-short w/o glyco CDS wt
auggaugcaaugaagagagggcucugcugugugcugcugcuguguggagcagucuucguuucggacauagaucccuauaaagaauuugguucaucuuaucaguuguugaauuuucuuccuuuggacuucuuuccugaccuuaaugcuuugguggacacugcuacugccuuguaugaagaagagcuaacagguagggaacauugcucuccgcaccauacagcuauuagacaagcuuuaguaugcugggaugaauuaacuaaauugauagcuuggaugagcucuaacauaacuucugaacaaguaagaacaaucauaguaaaucaugucaaugauaccuggggacuuaaggugagacaaaguuuaugguuucauuugucaugucucacuuuuggacaacauacaguucaagaauuuuuaguaaguuuuggaguauggaucagaacuccagcuccauauagaccuccuaaugcacccauucucucgacucuuccggaacauacagucauuuguggcggcggcggcuccggcggcggcggccaguauauaaaagcaaauucuaaauuuauagguauaacugaacuaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuauga

SEQ ID NO: 864 - RNA, 1062 nt, Artificial Sequence
  SP VLP peptide linker P2 VP8* P[8]-short w/o glyco CDS wt
auggaugcaaugaagagagggcucugcugugugcugcugcuguguggagcagucuucguuucggacauagaucccuauaaagaauuugguucaucuuaucaguuguugaauuuucuuccuuuggacuucuuuccugaccuuaaugcuuugguggacacugcuacugccuuguaugaagaagagcuaacagguagggaacauugcucuccgcaccauacagcuauuagacaagcuuuaguaugcugggaugaauuaacuaaauugauagcuuggaugagcucuaacauaacuucugaacaaguaagaacaaucauaguaaaucaugucaaugauaccuggggacuuaaggugagacaaaguuuaugguuucauuugucaugucucacuuuuggacaacauacaguucaagaauuuuuaguaaguuuuggaguauggaucagaacuccagcuccauauagaccuccuaaugcacccauucucucgacucuuccggaacauacagucauuuguggcggcggcggcuccggcggcggcggccaguauauaaaagcaaauucuaaauuuauagguauaacugaacuauuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucuguga

SEQ ID NO: 865 - RNA, 1062 nt, Artificial Sequence
  SP VLP peptide linker P2 VP8* P[8]-Wa-VirWa-short w/o glyco CDS wt
auggaugcaaugaagagagggcucugcugugugcugcugcuguguggagcagucuucguuucggacauagaucccuauaaagaauuugguucaucuuaucaguuguugaauuuucuuccuuuggacuucuuuccugaccuuaaugcuuugguggacacugcuacugccuuguaugaagaagagcuaacagguagggaacauugcucuccgcaccauacagcuauuagacaagcuuuaguaugcugggaugaauuaacuaaauugauagcuuggaugagcucuaacauaacuucugaacaaguaagaacaaucauaguaaaucaugucaaugauaccuggggacuuaaggugagacaaaguuuaugguuucauuugucaugucucacuuuuggacaacauacaguucaagaauuuuuaguaaguuuuggaguauggaucagaacuccagcuccauauagaccuccuaaugcacccauucucucgacucuuccggaacauacagucauuuguggcggcggcggcuccggcggcggcggccaguauauaaaagcaaauucuaaauuuauagguauaacugaacuauuagaugguccuuaucagccaacuacauuuacuccaccuaaugauuauuggauacuuauuaauucaaauacaaauggaguaguauaugaaaguacacagaauagugacuuuuggacugcagucguugcuauugaaccgcacguuaacccaguagauagacaauauacgauauuuggugaaaguaagcaauuuaaugugcguaacgauucaaauaaauggaaguuuuuagaaauguuuagaagcaguagucaaaaugaauuuuauaauagacguacauuaacuucugauacuagacuuguaggaauauugaaauaugguggaagaguauggacauuucauggugaaacaccaagagcuacuacugacaguucaaguacugcaaauuuaaaucagauaucaauuacaauucauucagaauuuuacauuauuccaaggucccaagaaucuaaauguaaugaauauauuaauaauggucuguga

SEQ ID NO: 866 - RNA, 3114 nt, Artificial Sequence
  SP 4x(P2 VP8* P[4]-long w/o glyco) CDS wt
auggaugcaaugaagagagggcucugcugugugcugcugcuguguggagcagucuucguuucgcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccaggcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccaggcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccaggcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccagguga

SEQ ID NO: 867 - RNA, 3114 nt, Artificial Sequence
  SP 4x(P2 VP8* P[6]-long w/o glyco) CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagacaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagacaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagacaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagauga

SEQ ID NO: 868 - RNA, 3114 nt, Artificial Sequence
  SP 4x(P2 VP8* P[8]-long w/o glyco) CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagacaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagacaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagacaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagauga

SEQ ID NO: 869 - RNA, 3646 nt, Artificial Sequence
  multicistronic P2 P[8]-[6]-[4]-long EMCV-IRES-4 CDS wt
augcaguauauaaaagcaaauucuaaauuuauagguauaacugaacuagcuucgcucauuuauagacagcuucucacuaauucauauucaguagauuuacaugaugaaauagaacaaauuggaucagaaaaaacucaaaauguaacuguaaauccagguccauuugcucaaacgagauaugcuccaguuaauuggggucauggagaaauaaaugauucaacgacaguggaaccaauuuuagaugguccuuaucaaccuacuacauuuacaccaccuacugauuauuggauacuuauuaccucaaauacaaauggaguaguauacgagaguacaaauaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagaugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagaauguaacgauuaaucccggaccguuugcucaaacaaauuaugcaccagugacuuggagucauggggaagugaaugauucgacaacaauagagccaguacucgaugguccuuaucaaccaacaaauuuuaagccaccaaacgauuacuggauauuauugaauccaacuaaucaacaaguuguauuagaagguaccaauaaaacugauaucuggguugcuuuauuacuuguugaaccaaacguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagaugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugcaguauauaaaagcaaauucuaaauuuauagguauaacugaacuagcuucgcucauuuauagacaacuucucacuaacucauauucgguagacuugcaugacgaaauagaacagauuggaucggagaaaacucaaaaugugacaguaaauccagguccauuugcacagacuagauaugcuccagucaauuggggacacggagagauuaaugauucaacuacaguggaaccaguuuuagaugguccuuaucaaccaacuacauuuaaaccacccaaugauuauuggcugcuuauuaguucgaauacagauggaguagucuaugagaguacaaauaauagugacuuuuggacagcggucauugcugucgaaccacaugucaaucaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaauaauauaucaauuauaauucauucagaguuuuauauuauuccaagaucccaagaaucuaaauguaaugaauauaucaauaaugguuuaccaccaauucaaaauacuagaaauguaguuccauuaucucuaucauccagguga

SEQ ID NO: 870 - RNA, 3226 nt, Artificial Sequence
  multicistronic P2 P[8]-[6]-[4]-long FMDV-IRES CDS wt
augcaguauauaaaagcaaauucuaaauuuauagguauaacugaacuagcuucgcucauuuauagacagcuucucacuaauucauauucaguagauuuacaugaugaaauagaacaaauuggaucagaaaaaacucaaaauguaacuguaaauccagguccauuugcucaaacgagauaugcuccaguuaauuggggucauggagaaauaaaugauucaacgacaguggaaccaauuuuagaugguccuuaucaaccuacuacauuuacaccaccuacugauuauuggauacuuauuaccucaaauacaaauggaguaguauacgagaguacaaauaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagaugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuaugcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagaauguaacgauuaaucccggaccguuugcucaaacaaauuaugcaccagugacuuggagucauggggaagugaaugauucgacaacaauagagccaguacucgaugguccuuaucaaccaacaaauuuuaagccaccaaacgauuacuggauauuauugaauccaacuaaucaacaaguuguauuagaagguaccaauaaaacugauaucuggguugcuuuauuacuuguugaaccaaacguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagaugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuaugcaguauauaaaagcaaauucuaaauuuauagguauaacugaacuagcuucgcucauuuauagacaacuucucacuaacucauauucgguagacuugcaugacgaaauagaacagauuggaucggagaaaacucaaaaugugacaguaaauccagguccauuugcacagacuagauaugcuccagucaauuggggacacggagagauuaaugauucaacuacaguggaaccaguuuuagaugguccuuaucaaccaacuacauuuaaaccacccaaugauuauuggcugcuuauuaguucgaauacagauggaguagucuaugagaguacaaauaauagugacuuuuggacagcggucauugcugucgaaccacaugucaaucaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaauaauauaucaauuauaauucauucagaguuuuauauuauuccaagaucccaagaaucuaaauguaaugaauauaucaauaaugguuuaccaccaauucaaaauacuagaaauguaguuccauuaucucuaucauccagguga

SEQ ID NO: 871 - RNA, 2430 nt, Artificial Sequence
  multicistronic P2 P[4]-[6]-[8]-long F2A CDS wt
augcaguauauaaaagcaaauucuaaauuuauagguauaacugaacuagcuucgcucauuuauagacaacuucucacuaacucauauucgguagacuugcaugacgaaauagaacagauuggaucggagaaaacucaaaaugugacaguaaauccagguccauuugcacagacuagauaugcuccagucaauuggggacacggagagauuaaugauucaacuacaguggaaccaguuuuagaugguccuuaucaaccaacuacauuuaaaccacccaaugauuauuggcugcuuauuaguucgaauacagauggaguagucuaugagaguacaaauaauagugacuuuuggacagcggucauugcugucgaaccacaugucaaucaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaauaauauaucaauuauaauucauucagaguuuuauauuauuccaagaucccaagaaucuaaauguaaugaauauaucaauaaugguuuaccaccaauucaaaauacuagaaauguaguuccauuaucucuaucauccagggugaagcagacacucaauuucgaccuucugaaguuggcuggagauguugagucuaacccaggccccaugcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagaauguaacgauuaaucccggaccguuugcucaaacaaauuaugcaccagugacuuggagucauggggaagugaaugauucgacaacaauagagccaguacucgaugguccuuaucaaccaacaaauuuuaagccaccaaacgauuacuggauauuauugaauccaacuaaucaacaaguuguauuagaagguaccaauaaaacugauaucuggguugcuuuauuacuuguugaaccaaacguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagagucaaacagaccuugaacuucgacuugcucaaacuggccggggauguggaguccaauccuggaccuaugcaguauauaaaagcaaauucuaaauuuauagguauaacugaacuagcuucgcucauuuauagacagcuucucacuaauucauauucaguagauuuacaugaugaaauagaacaaauuggaucagaaaaaacucaaaauguaacuguaaauccagguccauuugcucaaacgagauaugcuccaguuaauuggggucauggagaaauaaaugauucaacgacaguggaaccaauuuuagaugguccuuaucaaccuacuacauuuacaccaccuacugauuauuggauacuuauuaccucaaauacaaauggaguaguauacgagaguacaaauaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagauga

SEQ ID NO: 872 - RNA, 3826 nt, Artificial Sequence
  multicistronic SP P2 P[8]-[6]-[4]-long w/o glyco EMCV-IRES-4 CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagaugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggaugcaaugaagagagggcucugcugugugcugcugcuguguggagcagucuucguuucgcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagaugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggaugcaaugaagagagggcucugcugugugcugcugcuguguggagcagucuucguuucgcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccagguga

SEQ ID NO: 873 - RNA, 3406 nt, Artificial Sequence
  multicistronic SP P2 P[8]-[6]-[4]-long w/o glyco FMDV-IRES CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagaugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggaugcaaugaagagagggcucugcugugugcugcugcuguguggagcagucuucguuucgcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagaugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggaugcaaugaagagagggcucugcugugugcugcugcuguguggagcagucuucguuucgcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccagguga

SEQ ID NO: 874 - RNA, 2610 nt, Artificial Sequence
  multicistronic SP P2 P[4]-[6]-[8]-long w/o glyco F2A CDS wt
auggaugcaaugaagagagggcucugcugugugcugcugcuguguggagcagucuucguuucgcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccagggugaagcagacacucaauuucgaccuucugaaguuggcuggagauguugagucuaacccaggccccauggaugcaaugaagagagggcucugcugugugcugcugcuguguggagcagucuucguuucgcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagagucaaacagaccuugaacuucgacuugcucaaacuggccggggauguggaguccaauccuggaccuauggaugcaaugaagagagggcucugcugugugcugcugcuguguggagcagucuucguuucgcaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagauga

SEQ ID NO: 875 - RNA, 4240 nt, Artificial Sequence
  multicistronic SP P2 P[8]-[6]-[4]-long w/o glyco w TM domain EMCV-IRES-4 CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagaaagcuggaaucaacaaggauuuaccagauuuuggcgaucuauucaacugucgccaguucauugguacugguagucucccugggggcaaucaguuucuggaugugcucuaaugggucucuacaguguagaauauguauuugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggaugcaaugaagagagggcucugcugugugcugcugcuguguggagcagucuucguuucgcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagaaagcuggaaucaacaaggauuuaccagauuuuggcgaucuauucaacugucgccaguucauugguacugguagucucccugggggcaaucaguuucuggaugugcucuaaugggucucuacaguguagaauauguauuugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggaugcaaugaagagagggcucugcugugugcugcugcuguguggagcagucuucguuucgcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccaggaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 876 - RNA, 3820 nt, Artificial Sequence
  multicistronic SP P2 P[8]-[6]-[4]-long w/o glyco w TM domain FMDV-IRES CDS wt
auggaugcaaugaagagagggcucugcugugugcugcugcuguguggagcagucuucguuucgcaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagaaagcuggaaucaacaaggauuuaccagauuuuggcgaucuauucaacugucgccaguucauugguacugguagucucccugggggcaaucaguuucuggaugugcucuaaugggucucuacaguguagaauauguauuugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggaugcaaugaagagagggcucugcugugugcugcugcuguguggagcagucuucguuucgcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagaaagcuggaaucaacaaggauuuaccagauuuuggcgaucuauucaacugucgccaguucauugguacugguagucucccugggggcaaucaguuucuggaugugcucuaaugggucucuacaguguagaauauguauuugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggaugcaaugaagagagggcucugcugugugcugcugcuguguggagcagucuucguuucgcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccaggaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 877 - RNA, 3024 nt, Artificial Sequence
  multicistronic SP P2 P[4]-[6]-[8]-long w/o glyco w TM domain F2A CDS wt
auggaugcaaugaagagagggcucugcugugugcugcugcuguguggagcagucuucguuucgcaguauauaaaagcaaauucuaaauuuauagguauaacugaacuagcuucgcucauuuauagacaacuucucacuaacucauauucgguagacuugcaugacgaaauagaacagauuggaucggagaaaacucaacaggugacaguaaauccagguccauuugcacagacuagauaugcuccagucaauuggggacacggagagauucaggauucaacuacaguggaaccaguuuuagaugguccuuaucaaccaacuacauuuaaaccacccaaugauuauuggcugcuuauuaguucgaauacagauggaguagucuaugagaguacacagaauagugacuuuuggacagcggucauugcugucgaaccacauguccagcaaacaaauagacaauauguuuuauuuggugagaauaagcaguuuaacauagaaaauaguucagauaaauggaaauuuuucgagauguuuaaagguaauagucagagugauuuuucuaauagacggacuuuaaccucuagcaauagacuuguaggaaugcuaaaguaugguggaagaguauggacguuucauggugaaacaccaagagcuacuacugauaguucgaguacugcggauuuaaaucagauaucaauuauaauucauucagaguuuuauauuauuccaagaucccaagaaucuaaauguaaugaauauaucaauaaugguuuaccaccaauucaaaauacuagaaauguaguuccauuaucucuaucauccaggaagcuggaaucaacaaggauuuaccagauuuuggcgaucuauucaacugucgccaguucauugguacugguagucucccugggggcaaucaguuucuggaugugcucuaaugggucucuacaguguagaauauguauugugaagcagacacucaauuucgaccuucugaaguuggcuggagauguugagucuaacccaggccccauggaugcaaugaagagagggcucugcugugugcugcugcuguguggagcagucuucguuucgcaguauauaaaagcaaauucuaaauuuauagguauaacugaacuagcuucgcucauuuauagacagcuacucacuaauucauacacaguagaauuaucagaugaaaucaauacaauuggaucagaaaaaaaucagcagguaacgauuaaucccggaccguuugcucaaacaaauuaugcaccagugacuuggagucauggggaagugcaggauucgacaacaauagagccaguacucgaugguccuuaucaaccaacaaauuuuaagccaccaaacgauuacuggauauuauugaauccaacuaaucaacaaguuguauuagaagguacccagaaaacugauaucuggguugcuuuauuacuuguugaaccacagguaaccaaucaaaguagacaauacacauuauuuggagaaacgaaacaaauuacuguagaaaauaacacaaacaaauggaaauucuucgaaauguucagaaguaguguuagugcugaauuucaacauaagcgcacuuuaacaucagacacuaaauuagcuggguuuaugaaauuuuauaauaguguuuggacuuuucauggugaaacgccgaaugcuacaacugauuacucgucaacuucaaauuuauuugaaguagaaacuguaauacauguugaguuuuauauaauaccaagaucgcaagaaucuaaguguagugaauauauaaauacuggguuaccaccaaugcagaauacaaggaauauaguuccaguugcguuaucaucuagaaagcuggaaucaacaaggauuuaccagauuuuggcgaucuauucaacugucgccaguucauugguacugguagucucccugggggcaaucaguuucuggaugugcucuaaugggucucuacaguguagaauauguauugucaaacagaccuugaacuucgacuugcucaaacuggccggggauguggaguccaauccuggaccuauggaugcaaugaagagagggcucugcugugugcugcugcuguguggagcagucuucguuucgcaguauauaaaagcaaauucuaaauuuauagguauaacugaacuagcuucgcucauuuauagacagcuucucacuaauucauauucaguagauuuacaugaugaaauagaacaaauuggaucagaaaaaacucaacagguaacuguaaauccagguccauuugcucaaacgagauaugcuccaguuaauuggggucauggagaaauacaggauucaacgacaguggaaccaauuuuagaugguccuuaucaaccuacuacauuuacaccaccuacugauuauuggauacuuauuaccucaaauacaaauggaguaguauacgagaguacacagaauagugacuuuuggacugcagucauugcuguagaaccgcacgucaauccaguagauagacaauauaauguauuuggugaaaauaaacaauuuaauguaagaaaugauucagauaaauggaaguuuuuagaaauguuuagaggcaguagucaaaaugacuuuuauaauagacguacacuaacuucugauacuagacucguaggaauauuaaaauaugguggaagaguauggacauuucauggugaaacaccgagggcuaccacugauaguucaaacacugcaaauuuggacgguauaucaauuacaauucauucagaauuuuauauuauuccaaggucccaagagucuaaguguaaugaauauauuaacaacggucugccuccaauucaaaauacuagaaauguaguaccauuaucauuaucaucuagaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 878 - RNA, 723 nt, Artificial Sequence
  VP8* aa2-240 long P[4] CDS opt
auggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 879 - RNA, 723 nt, Artificial Sequence
  VP8* aa2-240 long P[6] CDS opt
auggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 880 - RNA, 723 nt, Artificial Sequence
  VP8* aa2-240 long P[8] CDS opt
auggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 881 - RNA, 723 nt, Artificial Sequence
  VP8* aa2-240 long P[8]-VirWaCDS opt
auggccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 882 - RNA, 783 nt, Artificial Sequence
  VP8* aa2-240 long P[4] P2+Linker CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 883 - RNA, 783 nt, Artificial Sequence
  VP8* aa2-240 long P[6] P2+Linker CDS opt
augcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 884 - RNA, 783 nt, Artificial Sequence
  VP8* aa2-240 long P[8] P2+Linker CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 885 - RNA, 783 nt, Artificial Sequence
  VP8* aa2-240 long P[8]-VirWa P2+Linker CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 886 - RNA, 783 nt, Artificial Sequence
  VP8* aa2-240 long P[4] SP(TPA) CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 887 - RNA, 783 nt, Artificial Sequence
  VP8* aa2-240 long P[6] SP(TPA) CDS opt
auggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 888 - RNA, 783 nt, Artificial Sequence
  VP8* aa2-240 long P[8] SP(TPA) CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 889 - RNA, 783 nt, Artificial Sequence
  VP8* aa2-240 long P[8]-VirWa SP(TPA) CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 890 - RNA, 774 nt, Artificial Sequence
  VP8* aa2-240 long P[4] SP(HSA) CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 891 - RNA, 774 nt, Artificial Sequence
  VP8* aa2-240 long P[6] SP(HSA) CDS opt
augaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 892 - RNA, 774 nt, Artificial Sequence
  VP8* aa2-240 long P[8] SP(HSA) CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 893 - RNA, 774 nt, Artificial Sequence
  VP8* aa2-240 long P[8]-VirWa SP(HSA) CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 894 - RNA, 774 nt, Artificial Sequence
  VP8* aa2-240 long P[4] SP(IgE) CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 895 - RNA, 774 nt, Artificial Sequence
  VP8* aa2-240 long P[6] SP(IgE) CDS opt
auggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 896 - RNA, 774 nt, Artificial Sequence
  VP8* aa2-240 long P[8] SP(IgE) CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 897 - RNA, 774 nt, Artificial Sequence
  VP8* aa2-240 long P[8]-VirWa SP(IgE) CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 898 - RNA, 792 nt, Artificial Sequence
  VP8* aa2-240 long P[4] SP(CD5) CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 899 - RNA, 792 nt, Artificial Sequence
  VP8* aa2-240 long P[6] SP(CD5) CDS opt
augcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 900 - RNA, 792 nt, Artificial Sequence
  VP8* aa2-240 long P[8] SP(CD5) CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 901 - RNA, 792 nt, Artificial Sequence
  VP8* aa2-240 long P[8]-VirWa SP(CD5) CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 902 - RNA, 792 nt, Artificial Sequence
  VP8* aa2-240 long P[4] SP(HLA-A2) CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 903 - RNA, 792 nt, Artificial Sequence
  VP8* aa2-240 long P[6] SP(HLA-A2) CDS opt
auggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 904 - RNA, 792 nt, Artificial Sequence
  VP8* aa2-240 long P[8] SP(HLA-A2) CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 905 - RNA, 792 nt, Artificial Sequence
  VP8* aa2-240 long P[8]-VirWa SP(HLA-A2) CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 906 - RNA, 843 nt, Artificial Sequence
  VP8* aa2-240 long P[4] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 907 - RNA, 843 nt, Artificial Sequence
  VP8* aa2-240 long P[6] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 908 - RNA, 843 nt, Artificial Sequence
  VP8* aa2-240 long P[8] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 909 - RNA, 843 nt, Artificial Sequence
  VP8* aa2-240 long P[8]-VirWa SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 910 - RNA, 834 nt, Artificial Sequence
  VP8* aa2-240 long P[4] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 911 - RNA, 834 nt, Artificial Sequence
  VP8* aa2-240 long P[6] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 912 - RNA, 834 nt, Artificial Sequence
  VP8* aa2-240 long P[8] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 913 - RNA, 834 nt, Artificial Sequence
  VP8* aa2-240 long P[8]-VirWa SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 914 - RNA, 834 nt, Artificial Sequence
  VP8* aa2-240 long P[4] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 915 - RNA, 834 nt, Artificial Sequence
  VP8* aa2-240 long P[6] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 916 - RNA, 834 nt, Artificial Sequence
  VP8* aa2-240 long P[8] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 917 - RNA, 834 nt, Artificial Sequence
  VP8* aa2-240 long P[8]-VirWa SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 918 - RNA, 852 nt, Artificial Sequence
  VP8* aa2-240 long P[4] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 919 - RNA, 852 nt, Artificial Sequence
  VP8* aa2-240 long P[6] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 920 - RNA, 852 nt, Artificial Sequence
  VP8* aa2-240 long P[8] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 921 - RNA, 852 nt, Artificial Sequence
  VP8* aa2-240 long P[8]-VirWa SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 922 - RNA, 852 nt, Artificial Sequence
  VP8* aa2-240 long P[4] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 923 - RNA, 852 nt, Artificial Sequence
  VP8* aa2-240 long P[6] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 924 - RNA, 852 nt, Artificial Sequence
  VP8* aa2-240 long P[8] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 925 - RNA, 852 nt, Artificial Sequence
  VP8* aa2-240 long P[8]-VirWa SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 926 - RNA, 723 nt, Artificial Sequence
  VP8* aa2-240 long P[4] w/o glyco CDS opt
auggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 927 - RNA, 723 nt, Artificial Sequence
  VP8* aa2-240 long P[6] w/o glyco CDS opt
auggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 928 - RNA, 723 nt, Artificial Sequence
  VP8* aa2-240 long P[8] w/o glyco CDS opt
auggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 929 - RNA, 723 nt, Artificial Sequence
  VP8* aa2-240 long P[8]-VirWa w/o glyco CDS opt
auggccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 930 - RNA, 783 nt, Artificial Sequence
  VP8* aa2-240 long P[4] P2+Linker w/o glyco CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 931 - RNA, 783 nt, Artificial Sequence
  VP8* aa2-240 long P[6] P2+Linker w/o glyco CDS opt
augcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 932 - RNA, 783 nt, Artificial Sequence
  VP8* aa2-240 long P[8] P2+Linker w/o glyco CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 933 - RNA, 783 nt, Artificial Sequence
  VP8* aa2-240 long P[8]-VirWa P2+Linker w/o glyco CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 934 - RNA, 783 nt, Artificial Sequence
  VP8* aa2-240 long P[4] SP(TPA) w/o glyco CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 935 - RNA, 783 nt, Artificial Sequence
  VP8* aa2-240 long P[6] SP(TPA) w/o glyco CDS opt
auggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 936 - RNA, 783 nt, Artificial Sequence
  VP8* aa2-240 long P[8] SP(TPA) w/o glyco CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 937 - RNA, 783 nt, Artificial Sequence
  VP8* aa2-240 long P[8]-VirWa SP(TPA) w/o glyco CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 938 - RNA, 774 nt, Artificial Sequence
  VP8* aa2-240 long P[4] SP(HSA) w/o glyco CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 939 - RNA, 774 nt, Artificial Sequence
  VP8* aa2-240 long P[6] SP(HSA) w/o glyco CDS opt
augaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 940 - RNA, 774 nt, Artificial Sequence
  VP8* aa2-240 long P[8] SP(HSA) w/o glyco CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 941 - RNA, 774 nt, Artificial Sequence
  VP8* aa2-240 long P[8]-VirWa SP(HSA) w/o glyco CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 942 - RNA, 774 nt, Artificial Sequence
  VP8* aa2-240 long P[4] SP(IgE) w/o glyco CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 943 - RNA, 774 nt, Artificial Sequence
  VP8* aa2-240 long P[6] SP(IgE) w/o glyco CDS opt
auggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 944 - RNA, 774 nt, Artificial Sequence
  VP8* aa2-240 long P[8] SP(IgE) w/o glyco CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 945 - RNA, 774 nt, Artificial Sequence
  VP8* aa2-240 long P[8]-VirWa SP(IgE) w/o glyco CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 946 - RNA, 792 nt, Artificial Sequence
  VP8* aa2-240 long P[4] SP(CD5) w/o glyco CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 947 - RNA, 792 nt, Artificial Sequence
  VP8* aa2-240 long P[6] SP(CD5) w/o glyco CDS opt
augcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 948 - RNA, 792 nt, Artificial Sequence
  VP8* aa2-240 long P[8] SP(CD5) w/o glyco CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 949 - RNA, 792 nt, Artificial Sequence
  VP8* aa2-240 long P[8]-VirWa SP(CD5) w/o glyco CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 950 - RNA, 792 nt, Artificial Sequence
  VP8* aa2-240 long P[4] SP(HLA-A2) w/o glyco CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 951 - RNA, 792 nt, Artificial Sequence
  VP8* aa2-240 long P[6] SP(HLA-A2) w/o glyco CDS opt
auggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 952 - RNA, 792 nt, Artificial Sequence
  VP8* aa2-240 long P[8] SP(HLA-A2) w/o glyco CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 953 - RNA, 792 nt, Artificial Sequence
  VP8* aa2-240 long P[8]-VirWa SP(HLA-A2) w/o glyco CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 954 - RNA, 843 nt, Artificial Sequence
  VP8* aa2-240 long P[4] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 955 - RNA, 843 nt, Artificial Sequence
  VP8* aa2-240 long P[6] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 956 - RNA, 843 nt, Artificial Sequence
  VP8* aa2-240 long P[8] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 957 - RNA, 843 nt, Artificial Sequence
  VP8* aa2-240 long P[8]-VirWa SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 958 - RNA, 834 nt, Artificial Sequence
  VP8* aa2-240 long P[4] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 959 - RNA, 834 nt, Artificial Sequence
  VP8* aa2-240 long P[6] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 960 - RNA, 834 nt, Artificial Sequence
  VP8* aa2-240 long P[8] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 961 - RNA, 834 nt, Artificial Sequence
  VP8* aa2-240 long P[8]-VirWa SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 962 - RNA, 834 nt, Artificial Sequence
  VP8* aa2-240 long P[4] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 963 - RNA, 834 nt, Artificial Sequence
  VP8* aa2-240 long P[6] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 964 - RNA, 834 nt, Artificial Sequence
  VP8* aa2-240 long P[8] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 965 - RNA, 834 nt, Artificial Sequence
  VP8* aa2-240 long P[8]-VirWa SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 966 - RNA, 852 nt, Artificial Sequence
  VP8* aa2-240 long P[4] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 967 - RNA, 852 nt, Artificial Sequence
  VP8* aa2-240 long P[6] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 968 - RNA, 852 nt, Artificial Sequence
  VP8* aa2-240 long P[8] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 969 - RNA, 852 nt, Artificial Sequence
  VP8* aa2-240 long P[8]-VirWa SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 970 - RNA, 852 nt, Artificial Sequence
  VP8* aa2-240 long P[4] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 971 - RNA, 852 nt, Artificial Sequence
  VP8* aa2-240 long P[6] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 972 - RNA, 852 nt, Artificial Sequence
  VP8* aa2-240 long P[8] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 973 - RNA, 852 nt, Artificial Sequence
  VP8* aa2-240 long P[8]-VirWa SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 974 - RNA, 693 nt, Artificial Sequence
  VP8* aa2-230 P[4] CDS opt
auggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 975 - RNA, 693 nt, Artificial Sequence
  VP8* aa2-230 P[6] CDS opt
auggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 976 - RNA, 693 nt, Artificial Sequence
  VP8* aa2-230 P[8] CDS opt
auggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 977 - RNA, 693 nt, Artificial Sequence
  VP8* aa2-230 P[8]-VirWaCDS opt
auggccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 978 - RNA, 753 nt, Artificial Sequence
  VP8* aa2-230 P[4] P2+Linker CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 979 - RNA, 753 nt, Artificial Sequence
  VP8* aa2-230 P[6] P2+Linker CDS opt
augcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 980 - RNA, 753 nt, Artificial Sequence
  VP8* aa2-230 P[8] P2+Linker CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 981 - RNA, 753 nt, Artificial Sequence
  VP8* aa2-230 P[8]-VirWa P2+Linker CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 982 - RNA, 753 nt, Artificial Sequence
  VP8* aa2-230 P[4] SP(TPA) CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 983 - RNA, 753 nt, Artificial Sequence
  VP8* aa2-230 P[6] SP(TPA) CDS opt
auggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 984 - RNA, 753 nt, Artificial Sequence
  VP8* aa2-230 P[8] SP(TPA) CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 985 - RNA, 753 nt, Artificial Sequence
  VP8* aa2-230 P[8]-VirWa SP(TPA) CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 986 - RNA, 744 nt, Artificial Sequence
  VP8* aa2-230 P[4] SP(HSA) CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 987 - RNA, 744 nt, Artificial Sequence
  VP8* aa2-230 P[6] SP(HSA) CDS opt
augaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 988 - RNA, 744 nt, Artificial Sequence
  VP8* aa2-230 P[8] SP(HSA) CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 989 - RNA, 744 nt, Artificial Sequence
  VP8* aa2-230 P[8]-VirWa SP(HSA) CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 990 - RNA, 744 nt, Artificial Sequence
  VP8* aa2-230 P[4] SP(IgE) CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 991 - RNA, 744 nt, Artificial Sequence
  VP8* aa2-230 P[6] SP(IgE) CDS opt
auggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 992 - RNA, 744 nt, Artificial Sequence
  VP8* aa2-230 P[8] SP(IgE) CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 993 - RNA, 744 nt, Artificial Sequence
  VP8* aa2-230 P[8]-VirWa SP(IgE) CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 994 - RNA, 762 nt, Artificial Sequence
  VP8* aa2-230 P[4] SP(CD5) CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 995 - RNA, 762 nt, Artificial Sequence
  VP8* aa2-230 P[6] SP(CD5) CDS opt
augcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 996 - RNA, 762 nt, Artificial Sequence
  VP8* aa2-230 P[8] SP(CD5) CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 997 - RNA, 762 nt, Artificial Sequence
  VP8* aa2-230 P[8]-VirWa SP(CD5) CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 998 - RNA, 762 nt, Artificial Sequence
  VP8* aa2-230 P[4] SP(HLA-A2) CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 999 - RNA, 762 nt, Artificial Sequence
  VP8* aa2-230 P[6] SP(HLA-A2) CDS opt
auggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1000 - RNA, 762 nt, Artificial Sequence
  VP8* aa2-230 P[8] SP(HLA-A2) CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 1001 - RNA, 762 nt, Artificial Sequence
  VP8* aa2-230 P[8]-VirWa SP(HLA-A2) CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 1002 - RNA, 813 nt, Artificial Sequence
  VP8* aa2-230 P[4] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 1003 - RNA, 813 nt, Artificial Sequence
  VP8* aa2-230 P[6] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1004 - RNA, 813 nt, Artificial Sequence
  VP8* aa2-230 P[8] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 1005 - RNA, 813 nt, Artificial Sequence
  VP8* aa2-230 P[8]-VirWa SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 1006 - RNA, 804 nt, Artificial Sequence
  VP8* aa2-230 P[4] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 1007 - RNA, 804 nt, Artificial Sequence
  VP8* aa2-230 P[6] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1008 - RNA, 804 nt, Artificial Sequence
  VP8* aa2-230 P[8] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 1009 - RNA, 804 nt, Artificial Sequence
  VP8* aa2-230 P[8]-VirWa SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 1010 - RNA, 804 nt, Artificial Sequence
  VP8* aa2-230 P[4] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 1011 - RNA, 804 nt, Artificial Sequence
  VP8* aa2-230 P[6] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1012 - RNA, 804 nt, Artificial Sequence
  VP8* aa2-230 P[8] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 1013 - RNA, 804 nt, Artificial Sequence
  VP8* aa2-230 P[8]-VirWa SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 1014 - RNA, 822 nt, Artificial Sequence
  VP8* aa2-230 P[4] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 1015 - RNA, 822 nt, Artificial Sequence
  VP8* aa2-230 P[6] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1016 - RNA, 822 nt, Artificial Sequence
  VP8* aa2-230 P[8] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 1017 - RNA, 822 nt, Artificial Sequence
  VP8* aa2-230 P[8]-VirWa SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 1018 - RNA, 822 nt, Artificial Sequence
  VP8* aa2-230 P[4] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccgguga

SEQ ID NO: 1019 - RNA, 822 nt, Artificial Sequence
  VP8* aa2-230 P[6] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1020 - RNA, 822 nt, Artificial Sequence
  VP8* aa2-230 P[8] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccgguga

SEQ ID NO: 1021 - RNA, 822 nt, Artificial Sequence
  VP8* aa2-230 P[8]-VirWa SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcgguga

SEQ ID NO: 1022 - RNA, 693 nt, Artificial Sequence
  VP8* aa2-230 P[4] w/o glyco CDS opt
auggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1023 - RNA, 693 nt, Artificial Sequence
  VP8* aa2-230 P[6] w/o glyco CDS opt
auggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1024 - RNA, 693 nt, Artificial Sequence
  VP8* aa2-230 P[8] w/o glyco CDS opt
auggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1025 - RNA, 693 nt, Artificial Sequence
  VP8* aa2-230 P[8]-VirWa w/o glyco CDS opt
auggccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1026 - RNA, 753 nt, Artificial Sequence
  VP8* aa2-230 P[4] P2+Linker w/o glyco CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1027 - RNA, 753 nt, Artificial Sequence
  VP8* aa2-230 P[6] P2+Linker w/o glyco CDS opt
augcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1028 - RNA, 753 nt, Artificial Sequence
  VP8* aa2-230 P[8] P2+Linker w/o glyco CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1029 - RNA, 753 nt, Artificial Sequence
  VP8* aa2-230 P[8]-VirWa P2+Linker w/o glyco CDS opt
augcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1030 - RNA, 753 nt, Artificial Sequence
  VP8* aa2-230 P[4] SP(TPA) w/o glyco CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1031 - RNA, 753 nt, Artificial Sequence
  VP8* aa2-230 P[6] SP(TPA) w/o glyco CDS opt
auggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1032 - RNA, 753 nt, Artificial Sequence
  VP8* aa2-230 P[8] SP(TPA) w/o glyco CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1033 - RNA, 753 nt, Artificial Sequence
  VP8* aa2-230 P[8]-VirWa SP(TPA) w/o glyco CDS opt
auggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1034 - RNA, 744 nt, Artificial Sequence
  VP8* aa2-230 P[4] SP(HSA) w/o glyco CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1035 - RNA, 744 nt, Artificial Sequence
  VP8* aa2-230 P[6] SP(HSA) w/o glyco CDS opt
augaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1036 - RNA, 744 nt, Artificial Sequence
  VP8* aa2-230 P[8] SP(HSA) w/o glyco CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1037 - RNA, 744 nt, Artificial Sequence
  VP8* aa2-230 P[8]-VirWa SP(HSA) w/o glyco CDS opt
augaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1038 - RNA, 744 nt, Artificial Sequence
  VP8* aa2-230 P[4] SP(IgE) w/o glyco CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1039 - RNA, 744 nt, Artificial Sequence
  VP8* aa2-230 P[6] SP(IgE) w/o glyco CDS opt
auggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1040 - RNA, 744 nt, Artificial Sequence
  VP8* aa2-230 P[8] SP(IgE) w/o glyco CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1041 - RNA, 744 nt, Artificial Sequence
  VP8* aa2-230 P[8]-VirWa SP(IgE) w/o glyco CDS opt
auggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1042 - RNA, 762 nt, Artificial Sequence
  VP8* aa2-230 P[4] SP(CD5) w/o glyco CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1043 - RNA, 762 nt, Artificial Sequence
  VP8* aa2-230 P[6] SP(CD5) w/o glyco CDS opt
augcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1044 - RNA, 762 nt, Artificial Sequence
  VP8* aa2-230 P[8] SP(CD5) w/o glyco CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1045 - RNA, 762 nt, Artificial Sequence
  VP8* aa2-230 P[8]-VirWa SP(CD5) w/o glyco CDS opt
augcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1046 - RNA, 762 nt, Artificial Sequence
  VP8* aa2-230 P[4] SP(HLA-A2) w/o glyco CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1047 - RNA, 762 nt, Artificial Sequence
  VP8* aa2-230 P[6] SP(HLA-A2) w/o glyco CDS opt
auggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1048 - RNA, 762 nt, Artificial Sequence
  VP8* aa2-230 P[8] SP(HLA-A2) w/o glyco CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1049 - RNA, 762 nt, Artificial Sequence
  VP8* aa2-230 P[8]-VirWa SP(HLA-A2) w/o glyco CDS opt
auggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1050 - RNA, 813 nt, Artificial Sequence
  VP8* aa2-230 P[4] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1051 - RNA, 813 nt, Artificial Sequence
  VP8* aa2-230 P[6] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1052 - RNA, 813 nt, Artificial Sequence
  VP8* aa2-230 P[8] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1053 - RNA, 813 nt, Artificial Sequence
  VP8* aa2-230 P[8]-VirWa SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1054 - RNA, 804 nt, Artificial Sequence
  VP8* aa2-230 P[4] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1055 - RNA, 804 nt, Artificial Sequence
  VP8* aa2-230 P[6] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1056 - RNA, 804 nt, Artificial Sequence
  VP8* aa2-230 P[8] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1057 - RNA, 804 nt, Artificial Sequence
  VP8* aa2-230 P[8]-VirWa SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1058 - RNA, 804 nt, Artificial Sequence
  VP8* aa2-230 P[4] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1059 - RNA, 804 nt, Artificial Sequence
  VP8* aa2-230 P[6] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1060 - RNA, 804 nt, Artificial Sequence
  VP8* aa2-230 P[8] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1061 - RNA, 804 nt, Artificial Sequence
  VP8* aa2-230 P[8]-VirWa SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1062 - RNA, 822 nt, Artificial Sequence
  VP8* aa2-230 P[4] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1063 - RNA, 822 nt, Artificial Sequence
  VP8* aa2-230 P[6] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1064 - RNA, 822 nt, Artificial Sequence
  VP8* aa2-230 P[8] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1065 - RNA, 822 nt, Artificial Sequence
  VP8* aa2-230 P[8]-VirWa SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1066 - RNA, 822 nt, Artificial Sequence
  VP8* aa2-230 P[4] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccgguga

SEQ ID NO: 1067 - RNA, 822 nt, Artificial Sequence
  VP8* aa2-230 P[6] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccgguga

SEQ ID NO: 1068 - RNA, 822 nt, Artificial Sequence
  VP8* aa2-230 P[8] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccgguga

SEQ ID NO: 1069 - RNA, 822 nt, Artificial Sequence
  VP8* aa2-230 P[8]-VirWa SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcgguga

SEQ ID NO: 1070 - RNA, 645 nt, Artificial Sequence
  VP8* aa11-223 P[4] CDS opt
augaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1071 - RNA, 645 nt, Artificial Sequence
  VP8* aa11-223 P[6] CDS opt
augaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1072 - RNA, 645 nt, Artificial Sequence
  VP8* aa11-223 P[8] CDS opt
augaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1073 - RNA, 645 nt, Artificial Sequence
  VP8* aa11-223 P[8]-VirWaCDS opt
augaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1074 - RNA, 705 nt, Artificial Sequence
  VP8* aa11-223 P[4] P2+Linker CDS opt
augcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1075 - RNA, 705 nt, Artificial Sequence
  VP8* aa11-223 P[6] P2+Linker CDS opt
augcaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1076 - RNA, 705 nt, Artificial Sequence
  VP8* aa11-223 P[8] P2+Linker CDS opt
augcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1077 - RNA, 705 nt, Artificial Sequence
  VP8* aa11-223 P[8]-VirWa P2+Linker CDS opt
augcaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1078 - RNA, 705 nt, Artificial Sequence
  VP8* aa11-223 P[4] SP(TPA) CDS opt
auggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1079 - RNA, 705 nt, Artificial Sequence
  VP8* aa11-223 P[6] SP(TPA) CDS opt
auggacgccaugaagcgcggccugugcugcgugcuccugcugugcggggccgucuucgugagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1080 - RNA, 705 nt, Artificial Sequence
  VP8* aa11-223 P[8] SP(TPA) CDS opt
auggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1081 - RNA, 705 nt, Artificial Sequence
  VP8* aa11-223 P[8]-VirWa SP(TPA) CDS opt
auggacgccaugaagcgcggccugugcugcgugcuccugcugugcggggccgucuucgugagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1082 - RNA, 696 nt, Artificial Sequence
  VP8* aa11-223 P[4] SP(HSA) CDS opt
augaagugggugaccuucaucagccugcucuuccuguucuccagcgccuacuccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1083 - RNA, 696 nt, Artificial Sequence
  VP8* aa11-223 P[6] SP(HSA) CDS opt
augaagugggugaccuucaucagccugcucuuccuguucuccagcgccuacuccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1084 - RNA, 696 nt, Artificial Sequence
  VP8* aa11-223 P[8] SP(HSA) CDS opt
augaagugggugaccuucaucagccugcucuuccuguucuccagcgccuacuccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1085 - RNA, 696 nt, Artificial Sequence
  VP8* aa11-223 P[8]-VirWa SP(HSA) CDS opt
augaagugggugaccuucaucagccugcucuuccuguucuccagcgccuacuccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1086 - RNA, 696 nt, Artificial Sequence
  VP8* aa11-223 P[4] SP(IgE) CDS opt
auggacuggaccuggauccuguuccucguggccgccgcgacccgcguccacagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1087 - RNA, 696 nt, Artificial Sequence
  VP8* aa11-223 P[6] SP(IgE) CDS opt
auggacuggaccuggauccuguuccucguggccgccgcgacccgcguccacagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1088 - RNA, 696 nt, Artificial Sequence
  VP8* aa11-223 P[8] SP(IgE) CDS opt
auggacuggaccuggauccuguuccucguggccgccgcgacccgcguccacagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1089 - RNA, 696 nt, Artificial Sequence
  VP8* aa11-223 P[8]-VirWa SP(IgE) CDS opt
auggacuggaccuggauccuguuccucguggccgccgcgacccgcguccacagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1090 - RNA, 714 nt, Artificial Sequence
  VP8* aa11-223 P[4] SP(CD5) CDS opt
augcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1091 - RNA, 714 nt, Artificial Sequence
  VP8* aa11-223 P[6] SP(CD5) CDS opt
augcccaugggcagccugcagccgcucgccacccuguaccugcucgggaugcugguggccuccugccugggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1092 - RNA, 714 nt, Artificial Sequence
  VP8* aa11-223 P[8] SP(CD5) CDS opt
augcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1093 - RNA, 714 nt, Artificial Sequence
  VP8* aa11-223 P[8]-VirWa SP(CD5) CDS opt
augcccaugggcagccugcagccgcucgccacccuguaccugcucgggaugcugguggccuccugccugggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1094 - RNA, 714 nt, Artificial Sequence
  VP8* aa11-223 P[4] SP(HLA-A2) CDS opt
auggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1095 - RNA, 714 nt, Artificial Sequence
  VP8* aa11-223 P[6] SP(HLA-A2) CDS opt
auggccgugauggccccgcggacccugguccuccugcugagcggcgcgcucgcccugacccagacgugggccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1096 - RNA, 714 nt, Artificial Sequence
  VP8* aa11-223 P[8] SP(HLA-A2) CDS opt
auggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1097 - RNA, 714 nt, Artificial Sequence
  VP8* aa11-223 P[8]-VirWa SP(HLA-A2) CDS opt
auggccgugauggccccgcggacccugguccuccugcugagcggcgcgcucgcccugacccagacgugggccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1098 - RNA, 765 nt, Artificial Sequence
  VP8* aa11-223 P[4] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1099 - RNA, 765 nt, Artificial Sequence
  VP8* aa11-223 P[6] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1100 - RNA, 765 nt, Artificial Sequence
  VP8* aa11-223 P[8] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1101 - RNA, 765 nt, Artificial Sequence
  VP8* aa11-223 P[8]-VirWa SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1102 - RNA, 756 nt, Artificial Sequence
  VP8* aa11-223 P[4] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1103 - RNA, 756 nt, Artificial Sequence
  VP8* aa11-223 P[6] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1104 - RNA, 756 nt, Artificial Sequence
  VP8* aa11-223 P[8] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1105 - RNA, 756 nt, Artificial Sequence
  VP8* aa11-223 P[8]-VirWa SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1106 - RNA, 756 nt, Artificial Sequence
  VP8* aa11-223 P[4] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1107 - RNA, 756 nt, Artificial Sequence
  VP8* aa11-223 P[6] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1108 - RNA, 756 nt, Artificial Sequence
  VP8* aa11-223 P[8] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1109 - RNA, 756 nt, Artificial Sequence
  VP8* aa11-223 P[8]-VirWa SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1110 - RNA, 774 nt, Artificial Sequence
  VP8* aa11-223 P[4] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1111 - RNA, 774 nt, Artificial Sequence
  VP8* aa11-223 P[6] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1112 - RNA, 774 nt, Artificial Sequence
  VP8* aa11-223 P[8] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1113 - RNA, 774 nt, Artificial Sequence
  VP8* aa11-223 P[8]-VirWa SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1114 - RNA, 774 nt, Artificial Sequence
  VP8* aa11-223 P[4] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1115 - RNA, 774 nt, Artificial Sequence
  VP8* aa11-223 P[6] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1116 - RNA, 774 nt, Artificial Sequence
  VP8* aa11-223 P[8] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1117 - RNA, 774 nt, Artificial Sequence
  VP8* aa11-223 P[8]-VirWa SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1118 - RNA, 645 nt, Artificial Sequence
  VP8* aa11-223 P[4] w/o glyco CDS opt
augaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1119 - RNA, 645 nt, Artificial Sequence
  VP8* aa11-223 P[6] w/o glyco CDS opt
augaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1120 - RNA, 645 nt, Artificial Sequence
  VP8* aa11-223 P[8] w/o glyco CDS opt
augaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1121 - RNA, 645 nt, Artificial Sequence
  VP8* aa11-223 P[8]-VirWa w/o glyco CDS opt
augaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1122 - RNA, 705 nt, Artificial Sequence
  VP8* aa11-223 P[4] P2+Linker w/o glyco CDS opt
augcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1123 - RNA, 705 nt, Artificial Sequence
  VP8* aa11-223 P[6] P2+Linker w/o glyco CDS opt
augcaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1124 - RNA, 705 nt, Artificial Sequence
  VP8* aa11-223 P[8] P2+Linker w/o glyco CDS opt
augcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1125 - RNA, 705 nt, Artificial Sequence
  VP8* aa11-223 P[8]-VirWa P2+Linker w/o glyco CDS opt
augcaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1126 - RNA, 705 nt, Artificial Sequence
  VP8* aa11-223 P[4] SP(TPA) w/o glyco CDS opt
auggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1127 - RNA, 705 nt, Artificial Sequence
  VP8* aa11-223 P[6] SP(TPA) w/o glyco CDS opt
auggacgccaugaagcgcggccugugcugcgugcuccugcugugcggggccgucuucgugagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1128 - RNA, 705 nt, Artificial Sequence
  VP8* aa11-223 P[8] SP(TPA) w/o glyco CDS opt
auggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1129 - RNA, 705 nt, Artificial Sequence
  VP8* aa11-223 P[8]-VirWa SP(TPA) w/o glyco CDS opt
auggacgccaugaagcgcggccugugcugcgugcuccugcugugcggggccgucuucgugagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1130 - RNA, 696 nt, Artificial Sequence
  VP8* aa11-223 P[4] SP(HSA) w/o glyco CDS opt
augaagugggugaccuucaucagccugcucuuccuguucuccagcgccuacuccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1131 - RNA, 696 nt, Artificial Sequence
  VP8* aa11-223 P[6] SP(HSA) w/o glyco CDS opt
augaagugggugaccuucaucagccugcucuuccuguucuccagcgccuacuccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1132 - RNA, 696 nt, Artificial Sequence
  VP8* aa11-223 P[8] SP(HSA) w/o glyco CDS opt
augaagugggugaccuucaucagccugcucuuccuguucuccagcgccuacuccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1133 - RNA, 696 nt, Artificial Sequence
  VP8* aa11-223 P[8]-VirWa SP(HSA) w/o glyco CDS opt
augaagugggugaccuucaucagccugcucuuccuguucuccagcgccuacuccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1134 - RNA, 696 nt, Artificial Sequence
  VP8* aa11-223 P[4] SP(IgE) w/o glyco CDS opt
auggacuggaccuggauccuguuccucguggccgccgcgacccgcguccacagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1135 - RNA, 696 nt, Artificial Sequence
  VP8* aa11-223 P[6] SP(IgE) w/o glyco CDS opt
auggacuggaccuggauccuguuccucguggccgccgcgacccgcguccacagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1136 - RNA, 696 nt, Artificial Sequence
  VP8* aa11-223 P[8] SP(IgE) w/o glyco CDS opt
auggacuggaccuggauccuguuccucguggccgccgcgacccgcguccacagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1137 - RNA, 696 nt, Artificial Sequence
  VP8* aa11-223 P[8]-VirWa SP(IgE) w/o glyco CDS opt
auggacuggaccuggauccuguuccucguggccgccgcgacccgcguccacagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1138 - RNA, 714 nt, Artificial Sequence
  VP8* aa11-223 P[4] SP(CD5) w/o glyco CDS opt
augcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1139 - RNA, 714 nt, Artificial Sequence
  VP8* aa11-223 P[6] SP(CD5) w/o glyco CDS opt
augcccaugggcagccugcagccgcucgccacccuguaccugcucgggaugcugguggccuccugccugggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1140 - RNA, 714 nt, Artificial Sequence
  VP8* aa11-223 P[8] SP(CD5) w/o glyco CDS opt
augcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1141 - RNA, 714 nt, Artificial Sequence
  VP8* aa11-223 P[8]-VirWa SP(CD5) w/o glyco CDS opt
augcccaugggcagccugcagccgcucgccacccuguaccugcucgggaugcugguggccuccugccugggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1142 - RNA, 714 nt, Artificial Sequence
  VP8* aa11-223 P[4] SP(HLA-A2) w/o glyco CDS opt
auggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1143 - RNA, 714 nt, Artificial Sequence
  VP8* aa11-223 P[6] SP(HLA-A2) w/o glyco CDS opt
auggccgugauggccccgcggacccugguccuccugcugagcggcgcgcucgcccugacccagacgugggccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1144 - RNA, 714 nt, Artificial Sequence
  VP8* aa11-223 P[8] SP(HLA-A2) w/o glyco CDS opt
auggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1145 - RNA, 714 nt, Artificial Sequence
  VP8* aa11-223 P[8]-VirWa SP(HLA-A2) w/o glyco CDS opt
auggccgugauggccccgcggacccugguccuccugcugagcggcgcgcucgcccugacccagacgugggccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1146 - RNA, 765 nt, Artificial Sequence
  VP8* aa11-223 P[4] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1147 - RNA, 765 nt, Artificial Sequence
  VP8* aa11-223 P[6] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1148 - RNA, 765 nt, Artificial Sequence
  VP8* aa11-223 P[8] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1149 - RNA, 765 nt, Artificial Sequence
  VP8* aa11-223 P[8]-VirWa SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1150 - RNA, 756 nt, Artificial Sequence
  VP8* aa11-223 P[4] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1151 - RNA, 756 nt, Artificial Sequence
  VP8* aa11-223 P[6] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1152 - RNA, 756 nt, Artificial Sequence
  VP8* aa11-223 P[8] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1153 - RNA, 756 nt, Artificial Sequence
  VP8* aa11-223 P[8]-VirWa SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1154 - RNA, 756 nt, Artificial Sequence
  VP8* aa11-223 P[4] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1155 - RNA, 756 nt, Artificial Sequence
  VP8* aa11-223 P[6] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1156 - RNA, 756 nt, Artificial Sequence
  VP8* aa11-223 P[8] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1157 - RNA, 756 nt, Artificial Sequence
  VP8* aa11-223 P[8]-VirWa SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1158 - RNA, 774 nt, Artificial Sequence
  VP8* aa11-223 P[4] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1159 - RNA, 774 nt, Artificial Sequence
  VP8* aa11-223 P[6] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1160 - RNA, 774 nt, Artificial Sequence
  VP8* aa11-223 P[8] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1161 - RNA, 774 nt, Artificial Sequence
  VP8* aa11-223 P[8]-VirWa SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1162 - RNA, 774 nt, Artificial Sequence
  VP8* aa11-223 P[4] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1163 - RNA, 774 nt, Artificial Sequence
  VP8* aa11-223 P[6] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1164 - RNA, 774 nt, Artificial Sequence
  VP8* aa11-223 P[8] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1165 - RNA, 774 nt, Artificial Sequence
  VP8* aa11-223 P[8]-VirWa SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1166 - RNA, 696 nt, Artificial Sequence
  VP8* aa11-240 P[4] CDS opt
augaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1167 - RNA, 696 nt, Artificial Sequence
  VP8* aa11-240 P[6] CDS opt
augaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1168 - RNA, 696 nt, Artificial Sequence
  VP8* aa11-240 P[8] CDS opt
augaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1169 - RNA, 696 nt, Artificial Sequence
  VP8* aa11-240 P[8]-VirWaCDS opt
augaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1170 - RNA, 756 nt, Artificial Sequence
  VP8* aa11-240 P[4] P2+Linker CDS opt
augcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1171 - RNA, 756 nt, Artificial Sequence
  VP8* aa11-240 P[6] P2+Linker CDS opt
augcaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1172 - RNA, 756 nt, Artificial Sequence
  VP8* aa11-240 P[8] P2+Linker CDS opt
augcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1173 - RNA, 756 nt, Artificial Sequence
  VP8* aa11-240 P[8]-VirWa P2+Linker CDS opt
augcaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1174 - RNA, 756 nt, Artificial Sequence
  VP8* aa11-240 P[4] SP(TPA) CDS opt
auggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1175 - RNA, 756 nt, Artificial Sequence
  VP8* aa11-240 P[6] SP(TPA) CDS opt
auggacgccaugaagcgcggccugugcugcgugcuccugcugugcggggccgucuucgugagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1176 - RNA, 756 nt, Artificial Sequence
  VP8* aa11-240 P[8] SP(TPA) CDS opt
auggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1177 - RNA, 756 nt, Artificial Sequence
  VP8* aa11-240 P[8]-VirWa SP(TPA) CDS opt
auggacgccaugaagcgcggccugugcugcgugcuccugcugugcggggccgucuucgugagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1178 - RNA, 747 nt, Artificial Sequence
  VP8* aa11-240 P[4] SP(HSA) CDS opt
augaagugggugaccuucaucagccugcucuuccuguucuccagcgccuacuccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1179 - RNA, 747 nt, Artificial Sequence
  VP8* aa11-240 P[6] SP(HSA) CDS opt
augaagugggugaccuucaucagccugcucuuccuguucuccagcgccuacuccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1180 - RNA, 747 nt, Artificial Sequence
  VP8* aa11-240 P[8] SP(HSA) CDS opt
augaagugggugaccuucaucagccugcucuuccuguucuccagcgccuacuccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1181 - RNA, 747 nt, Artificial Sequence
  VP8* aa11-240 P[8]-VirWa SP(HSA) CDS opt
augaagugggugaccuucaucagccugcucuuccuguucuccagcgccuacuccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1182 - RNA, 747 nt, Artificial Sequence
  VP8* aa11-240 P[4] SP(IgE) CDS opt
auggacuggaccuggauccuguuccucguggccgccgcgacccgcguccacagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1183 - RNA, 747 nt, Artificial Sequence
  VP8* aa11-240 P[6] SP(IgE) CDS opt
auggacuggaccuggauccuguuccucguggccgccgcgacccgcguccacagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1184 - RNA, 747 nt, Artificial Sequence
  VP8* aa11-240 P[8] SP(IgE) CDS opt
auggacuggaccuggauccuguuccucguggccgccgcgacccgcguccacagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1185 - RNA, 747 nt, Artificial Sequence
  VP8* aa11-240 P[8]-VirWa SP(IgE) CDS opt
auggacuggaccuggauccuguuccucguggccgccgcgacccgcguccacagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1186 - RNA, 765 nt, Artificial Sequence
  VP8* aa11-240 P[4] SP(CD5) CDS opt
augcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1187 - RNA, 765 nt, Artificial Sequence
  VP8* aa11-240 P[6] SP(CD5) CDS opt
augcccaugggcagccugcagccgcucgccacccuguaccugcucgggaugcugguggccuccugccugggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1188 - RNA, 765 nt, Artificial Sequence
  VP8* aa11-240 P[8] SP(CD5) CDS opt
augcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1189 - RNA, 765 nt, Artificial Sequence
  VP8* aa11-240 P[8]-VirWa SP(CD5) CDS opt
augcccaugggcagccugcagccgcucgccacccuguaccugcucgggaugcugguggccuccugccugggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1190 - RNA, 765 nt, Artificial Sequence
  VP8* aa11-240 P[4] SP(HLA-A2) CDS opt
auggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1191 - RNA, 765 nt, Artificial Sequence
  VP8* aa11-240 P[6] SP(HLA-A2) CDS opt
auggccgugauggccccgcggacccugguccuccugcugagcggcgcgcucgcccugacccagacgugggccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1192 - RNA, 765 nt, Artificial Sequence
  VP8* aa11-240 P[8] SP(HLA-A2) CDS opt
auggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1193 - RNA, 765 nt, Artificial Sequence
  VP8* aa11-240 P[8]-VirWa SP(HLA-A2) CDS opt
auggccgugauggccccgcggacccugguccuccugcugagcggcgcgcucgcccugacccagacgugggccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1194 - RNA, 816 nt, Artificial Sequence
  VP8* aa11-240 P[4] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1195 - RNA, 816 nt, Artificial Sequence
  VP8* aa11-240 P[6] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1196 - RNA, 816 nt, Artificial Sequence
  VP8* aa11-240 P[8] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1197 - RNA, 816 nt, Artificial Sequence
  VP8* aa11-240 P[8]-VirWa SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1198 - RNA, 807 nt, Artificial Sequence
  VP8* aa11-240 P[4] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1199 - RNA, 807 nt, Artificial Sequence
  VP8* aa11-240 P[6] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1200 - RNA, 807 nt, Artificial Sequence
  VP8* aa11-240 P[8] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1201 - RNA, 807 nt, Artificial Sequence
  VP8* aa11-240 P[8]-VirWa SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1202 - RNA, 807 nt, Artificial Sequence
  VP8* aa11-240 P[4] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1203 - RNA, 807 nt, Artificial Sequence
  VP8* aa11-240 P[6] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1204 - RNA, 807 nt, Artificial Sequence
  VP8* aa11-240 P[8] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1205 - RNA, 807 nt, Artificial Sequence
  VP8* aa11-240 P[8]-VirWa SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1206 - RNA, 825 nt, Artificial Sequence
  VP8* aa11-240 P[4] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1207 - RNA, 825 nt, Artificial Sequence
  VP8* aa11-240 P[6] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1208 - RNA, 825 nt, Artificial Sequence
  VP8* aa11-240 P[8] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1209 - RNA, 825 nt, Artificial Sequence
  VP8* aa11-240 P[8]-VirWa SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1210 - RNA, 825 nt, Artificial Sequence
  VP8* aa11-240 P[4] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1211 - RNA, 825 nt, Artificial Sequence
  VP8* aa11-240 P[6] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1212 - RNA, 825 nt, Artificial Sequence
  VP8* aa11-240 P[8] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1213 - RNA, 825 nt, Artificial Sequence
  VP8* aa11-240 P[8]-VirWa SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1214 - RNA, 696 nt, Artificial Sequence
  VP8* aa11-240 P[4] w/o glyco CDS opt
augaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1215 - RNA, 696 nt, Artificial Sequence
  VP8* aa11-240 P[6] w/o glyco CDS opt
augaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1216 - RNA, 696 nt, Artificial Sequence
  VP8* aa11-240 P[8] w/o glyco CDS opt
augaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1217 - RNA, 696 nt, Artificial Sequence
  VP8* aa11-240 P[8]-VirWa w/o glyco CDS opt
augaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1218 - RNA, 756 nt, Artificial Sequence
  VP8* aa11-240 P[4] P2+Linker w/o glyco CDS opt
augcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1219 - RNA, 756 nt, Artificial Sequence
  VP8* aa11-240 P[6] P2+Linker w/o glyco CDS opt
augcaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1220 - RNA, 756 nt, Artificial Sequence
  VP8* aa11-240 P[8] P2+Linker w/o glyco CDS opt
augcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1221 - RNA, 756 nt, Artificial Sequence
  VP8* aa11-240 P[8]-VirWa P2+Linker w/o glyco CDS opt
augcaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1222 - RNA, 756 nt, Artificial Sequence
  VP8* aa11-240 P[4] SP(TPA) w/o glyco CDS opt
auggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1223 - RNA, 756 nt, Artificial Sequence
  VP8* aa11-240 P[6] SP(TPA) w/o glyco CDS opt
auggacgccaugaagcgcggccugugcugcgugcuccugcugugcggggccgucuucgugagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1224 - RNA, 756 nt, Artificial Sequence
  VP8* aa11-240 P[8] SP(TPA) w/o glyco CDS opt
auggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1225 - RNA, 756 nt, Artificial Sequence
  VP8* aa11-240 P[8]-VirWa SP(TPA) w/o glyco CDS opt
auggacgccaugaagcgcggccugugcugcgugcuccugcugugcggggccgucuucgugagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1226 - RNA, 747 nt, Artificial Sequence
  VP8* aa11-240 P[4] SP(HSA) w/o glyco CDS opt
augaagugggugaccuucaucagccugcucuuccuguucuccagcgccuacuccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1227 - RNA, 747 nt, Artificial Sequence
  VP8* aa11-240 P[6] SP(HSA) w/o glyco CDS opt
augaagugggugaccuucaucagccugcucuuccuguucuccagcgccuacuccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1228 - RNA, 747 nt, Artificial Sequence
  VP8* aa11-240 P[8] SP(HSA) w/o glyco CDS opt
augaagugggugaccuucaucagccugcucuuccuguucuccagcgccuacuccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1229 - RNA, 747 nt, Artificial Sequence
  VP8* aa11-240 P[8]-VirWa SP(HSA) w/o glyco CDS opt
augaagugggugaccuucaucagccugcucuuccuguucuccagcgccuacuccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1230 - RNA, 747 nt, Artificial Sequence
  VP8* aa11-240 P[4] SP(IgE) w/o glyco CDS opt
auggacuggaccuggauccuguuccucguggccgccgcgacccgcguccacagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1231 - RNA, 747 nt, Artificial Sequence
  VP8* aa11-240 P[6] SP(IgE) w/o glyco CDS opt
auggacuggaccuggauccuguuccucguggccgccgcgacccgcguccacagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1232 - RNA, 747 nt, Artificial Sequence
  VP8* aa11-240 P[8] SP(IgE) w/o glyco CDS opt
auggacuggaccuggauccuguuccucguggccgccgcgacccgcguccacagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1233 - RNA, 747 nt, Artificial Sequence
  VP8* aa11-240 P[8]-VirWa SP(IgE) w/o glyco CDS opt
auggacuggaccuggauccuguuccucguggccgccgcgacccgcguccacagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1234 - RNA, 765 nt, Artificial Sequence
  VP8* aa11-240 P[4] SP(CD5) w/o glyco CDS opt
augcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1235 - RNA, 765 nt, Artificial Sequence
  VP8* aa11-240 P[6] SP(CD5) w/o glyco CDS opt
augcccaugggcagccugcagccgcucgccacccuguaccugcucgggaugcugguggccuccugccugggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1236 - RNA, 765 nt, Artificial Sequence
  VP8* aa11-240 P[8] SP(CD5) w/o glyco CDS opt
augcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1237 - RNA, 765 nt, Artificial Sequence
  VP8* aa11-240 P[8]-VirWa SP(CD5) w/o glyco CDS opt
augcccaugggcagccugcagccgcucgccacccuguaccugcucgggaugcugguggccuccugccugggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1238 - RNA, 765 nt, Artificial Sequence
  VP8* aa11-240 P[4] SP(HLA-A2) w/o glyco CDS opt
auggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1239 - RNA, 765 nt, Artificial Sequence
  VP8* aa11-240 P[6] SP(HLA-A2) w/o glyco CDS opt
auggccgugauggccccgcggacccugguccuccugcugagcggcgcgcucgcccugacccagacgugggccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1240 - RNA, 765 nt, Artificial Sequence
  VP8* aa11-240 P[8] SP(HLA-A2) w/o glyco CDS opt
auggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1241 - RNA, 765 nt, Artificial Sequence
  VP8* aa11-240 P[8]-VirWa SP(HLA-A2) w/o glyco CDS opt
auggccgugauggccccgcggacccugguccuccugcugagcggcgcgcucgcccugacccagacgugggccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1242 - RNA, 816 nt, Artificial Sequence
  VP8* aa11-240 P[4] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1243 - RNA, 816 nt, Artificial Sequence
  VP8* aa11-240 P[6] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1244 - RNA, 816 nt, Artificial Sequence
  VP8* aa11-240 P[8] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1245 - RNA, 816 nt, Artificial Sequence
  VP8* aa11-240 P[8]-VirWa SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1246 - RNA, 807 nt, Artificial Sequence
  VP8* aa11-240 P[4] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1247 - RNA, 807 nt, Artificial Sequence
  VP8* aa11-240 P[6] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1248 - RNA, 807 nt, Artificial Sequence
  VP8* aa11-240 P[8] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1249 - RNA, 807 nt, Artificial Sequence
  VP8* aa11-240 P[8]-VirWa SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1250 - RNA, 807 nt, Artificial Sequence
  VP8* aa11-240 P[4] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1251 - RNA, 807 nt, Artificial Sequence
  VP8* aa11-240 P[6] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1252 - RNA, 807 nt, Artificial Sequence
  VP8* aa11-240 P[8] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1253 - RNA, 807 nt, Artificial Sequence
  VP8* aa11-240 P[8]-VirWa SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1254 - RNA, 825 nt, Artificial Sequence
  VP8* aa11-240 P[4] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1255 - RNA, 825 nt, Artificial Sequence
  VP8* aa11-240 P[6] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1256 - RNA, 825 nt, Artificial Sequence
  VP8* aa11-240 P[8] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1257 - RNA, 825 nt, Artificial Sequence
  VP8* aa11-240 P[8]-VirWa SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1258 - RNA, 825 nt, Artificial Sequence
  VP8* aa11-240 P[4] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1259 - RNA, 825 nt, Artificial Sequence
  VP8* aa11-240 P[6] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1260 - RNA, 825 nt, Artificial Sequence
  VP8* aa11-240 P[8] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1261 - RNA, 825 nt, Artificial Sequence
  VP8* aa11-240 P[8]-VirWa SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1262 - RNA, 666 nt, Artificial Sequence
  VP8* aa21-240 P[4] CDS opt
auggagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1263 - RNA, 666 nt, Artificial Sequence
  VP8* aa21-240 P[6] CDS opt
auggagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1264 - RNA, 666 nt, Artificial Sequence
  VP8* aa21-240 P[8] CDS opt
auggagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1265 - RNA, 666 nt, Artificial Sequence
  VP8* aa21-240 P[8]-VirWaCDS opt
auggagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1266 - RNA, 726 nt, Artificial Sequence
  VP8* aa21-240 P[4] P2+Linker CDS opt
augcaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1267 - RNA, 726 nt, Artificial Sequence
  VP8* aa21-240 P[6] P2+Linker CDS opt
augcaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1268 - RNA, 726 nt, Artificial Sequence
  VP8* aa21-240 P[8] P2+Linker CDS opt
augcaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1269 - RNA, 726 nt, Artificial Sequence
  VP8* aa21-240 P[8]-VirWa P2+Linker CDS opt
augcaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1270 - RNA, 726 nt, Artificial Sequence
  VP8* aa21-240 P[4] SP(TPA) CDS opt
auggacgccaugaagcgcggccugugcugcgugcuccugcugugcggggccgucuucgugagcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1271 - RNA, 726 nt, Artificial Sequence
  VP8* aa21-240 P[6] SP(TPA) CDS opt
auggacgccaugaagcgcggccugugcugcgugcuccugcugugcggggccgucuucgugagcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1272 - RNA, 726 nt, Artificial Sequence
  VP8* aa21-240 P[8] SP(TPA) CDS opt
auggacgccaugaagcgcggccugugcugcgugcuccugcugugcggggccgucuucgugagcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1273 - RNA, 726 nt, Artificial Sequence
  VP8* aa21-240 P[8]-VirWa SP(TPA) CDS opt
auggacgccaugaagcgcggccugugcugcgugcuccugcugugcggggccgucuucgugagcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1274 - RNA, 717 nt, Artificial Sequence
  VP8* aa21-240 P[4] SP(HSA) CDS opt
augaagugggugaccuucaucagccugcucuuccuguucuccagcgccuacuccgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1275 - RNA, 717 nt, Artificial Sequence
  VP8* aa21-240 P[6] SP(HSA) CDS opt
augaagugggugaccuucaucagccugcucuuccuguucuccagcgccuacuccgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1276 - RNA, 717 nt, Artificial Sequence
  VP8* aa21-240 P[8] SP(HSA) CDS opt
augaagugggugaccuucaucagccugcucuuccuguucuccagcgccuacuccgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1277 - RNA, 717 nt, Artificial Sequence
  VP8* aa21-240 P[8]-VirWa SP(HSA) CDS opt
augaagugggugaccuucaucagccugcucuuccuguucuccagcgccuacuccgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1278 - RNA, 717 nt, Artificial Sequence
  VP8* aa21-240 P[4] SP(IgE) CDS opt
auggacuggaccuggauccuguuccucguggccgccgcgacccgcguccacagcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1279 - RNA, 717 nt, Artificial Sequence
  VP8* aa21-240 P[6] SP(IgE) CDS opt
auggacuggaccuggauccuguuccucguggccgccgcgacccgcguccacagcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1280 - RNA, 717 nt, Artificial Sequence
  VP8* aa21-240 P[8] SP(IgE) CDS opt
auggacuggaccuggauccuguuccucguggccgccgcgacccgcguccacagcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1281 - RNA, 717 nt, Artificial Sequence
  VP8* aa21-240 P[8]-VirWa SP(IgE) CDS opt
auggacuggaccuggauccuguuccucguggccgccgcgacccgcguccacagcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1282 - RNA, 735 nt, Artificial Sequence
  VP8* aa21-240 P[4] SP(CD5) CDS opt
augcccaugggcagccugcagccgcucgccacccuguaccugcucgggaugcugguggccuccugccugggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1283 - RNA, 735 nt, Artificial Sequence
  VP8* aa21-240 P[6] SP(CD5) CDS opt
augcccaugggcagccugcagccgcucgccacccuguaccugcucgggaugcugguggccuccugccugggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1284 - RNA, 735 nt, Artificial Sequence
  VP8* aa21-240 P[8] SP(CD5) CDS opt
augcccaugggcagccugcagccgcucgccacccuguaccugcucgggaugcugguggccuccugccugggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1285 - RNA, 735 nt, Artificial Sequence
  VP8* aa21-240 P[8]-VirWa SP(CD5) CDS opt
augcccaugggcagccugcagccgcucgccacccuguaccugcucgggaugcugguggccuccugccugggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1286 - RNA, 735 nt, Artificial Sequence
  VP8* aa21-240 P[4] SP(HLA-A2) CDS opt
auggccgugauggccccgcggacccugguccuccugcugagcggcgcgcucgcccugacccagacgugggccgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1287 - RNA, 735 nt, Artificial Sequence
  VP8* aa21-240 P[6] SP(HLA-A2) CDS opt
auggccgugauggccccgcggacccugguccuccugcugagcggcgcgcucgcccugacccagacgugggccgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1288 - RNA, 735 nt, Artificial Sequence
  VP8* aa21-240 P[8] SP(HLA-A2) CDS opt
auggccgugauggccccgcggacccugguccuccugcugagcggcgcgcucgcccugacccagacgugggccgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1289 - RNA, 735 nt, Artificial Sequence
  VP8* aa21-240 P[8]-VirWa SP(HLA-A2) CDS opt
auggccgugauggccccgcggacccugguccuccugcugagcggcgcgcucgcccugacccagacgugggccgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1290 - RNA, 786 nt, Artificial Sequence
  VP8* aa21-240 P[4] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1291 - RNA, 786 nt, Artificial Sequence
  VP8* aa21-240 P[6] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1292 - RNA, 786 nt, Artificial Sequence
  VP8* aa21-240 P[8] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1293 - RNA, 786 nt, Artificial Sequence
  VP8* aa21-240 P[8]-VirWa SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1294 - RNA, 777 nt, Artificial Sequence
  VP8* aa21-240 P[4] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1295 - RNA, 777 nt, Artificial Sequence
  VP8* aa21-240 P[6] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1296 - RNA, 777 nt, Artificial Sequence
  VP8* aa21-240 P[8] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1297 - RNA, 777 nt, Artificial Sequence
  VP8* aa21-240 P[8]-VirWa SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1298 - RNA, 777 nt, Artificial Sequence
  VP8* aa21-240 P[4] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1299 - RNA, 777 nt, Artificial Sequence
  VP8* aa21-240 P[6] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1300 - RNA, 777 nt, Artificial Sequence
  VP8* aa21-240 P[8] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1301 - RNA, 777 nt, Artificial Sequence
  VP8* aa21-240 P[8]-VirWa SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1302 - RNA, 795 nt, Artificial Sequence
  VP8* aa21-240 P[4] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1303 - RNA, 795 nt, Artificial Sequence
  VP8* aa21-240 P[6] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1304 - RNA, 795 nt, Artificial Sequence
  VP8* aa21-240 P[8] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1305 - RNA, 795 nt, Artificial Sequence
  VP8* aa21-240 P[8]-VirWa SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1306 - RNA, 795 nt, Artificial Sequence
  VP8* aa21-240 P[4] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1307 - RNA, 795 nt, Artificial Sequence
  VP8* aa21-240 P[6] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1308 - RNA, 795 nt, Artificial Sequence
  VP8* aa21-240 P[8] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1309 - RNA, 795 nt, Artificial Sequence
  VP8* aa21-240 P[8]-VirWa SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcuga

SEQ ID NO: 1310 - RNA, 666 nt, Artificial Sequence
  VP8* aa21-240 P[4] w/o glyco CDS opt
auggagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1311 - RNA, 666 nt, Artificial Sequence
  VP8* aa21-240 P[6] w/o glyco CDS opt
auggagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1312 - RNA, 666 nt, Artificial Sequence
  VP8* aa21-240 P[8] w/o glyco CDS opt
auggagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1313 - RNA, 666 nt, Artificial Sequence
  VP8* aa21-240 P[8]-VirWa w/o glyco CDS opt
auggagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1314 - RNA, 726 nt, Artificial Sequence
  VP8* aa21-240 P[4] P2+Linker w/o glyco CDS opt
augcaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1315 - RNA, 726 nt, Artificial Sequence
  VP8* aa21-240 P[6] P2+Linker w/o glyco CDS opt
augcaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1316 - RNA, 726 nt, Artificial Sequence
  VP8* aa21-240 P[8] P2+Linker w/o glyco CDS opt
augcaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1317 - RNA, 726 nt, Artificial Sequence
  VP8* aa21-240 P[8]-VirWa P2+Linker w/o glyco CDS opt
augcaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1318 - RNA, 726 nt, Artificial Sequence
  VP8* aa21-240 P[4] SP(TPA) w/o glyco CDS opt
auggacgccaugaagcgcggccugugcugcgugcuccugcugugcggggccgucuucgugagcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1319 - RNA, 726 nt, Artificial Sequence
  VP8* aa21-240 P[6] SP(TPA) w/o glyco CDS opt
auggacgccaugaagcgcggccugugcugcgugcuccugcugugcggggccgucuucgugagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1320 - RNA, 726 nt, Artificial Sequence
  VP8* aa21-240 P[8] SP(TPA) w/o glyco CDS opt
auggacgccaugaagcgcggccugugcugcgugcuccugcugugcggggccgucuucgugagcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1321 - RNA, 726 nt, Artificial Sequence
  VP8* aa21-240 P[8]-VirWa SP(TPA) w/o glyco CDS opt
auggacgccaugaagcgcggccugugcugcgugcuccugcugugcggggccgucuucgugagcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1322 - RNA, 717 nt, Artificial Sequence
  VP8* aa21-240 P[4] SP(HSA) w/o glyco CDS opt
augaagugggugaccuucaucagccugcucuuccuguucuccagcgccuacuccgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1323 - RNA, 717 nt, Artificial Sequence
  VP8* aa21-240 P[6] SP(HSA) w/o glyco CDS opt
augaagugggugaccuucaucagccugcucuuccuguucuccagcgccuacuccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1324 - RNA, 717 nt, Artificial Sequence
  VP8* aa21-240 P[8] SP(HSA) w/o glyco CDS opt
augaagugggugaccuucaucagccugcucuuccuguucuccagcgccuacuccgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1325 - RNA, 717 nt, Artificial Sequence
  VP8* aa21-240 P[8]-VirWa SP(HSA) w/o glyco CDS opt
augaagugggugaccuucaucagccugcucuuccuguucuccagcgccuacuccgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1326 - RNA, 717 nt, Artificial Sequence
  VP8* aa21-240 P[4] SP(IgE) w/o glyco CDS opt
auggacuggaccuggauccuguuccucguggccgccgcgacccgcguccacagcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1327 - RNA, 717 nt, Artificial Sequence
  VP8* aa21-240 P[6] SP(IgE) w/o glyco CDS opt
auggacuggaccuggauccuguuccucguggccgccgcgacccgcguccacagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1328 - RNA, 717 nt, Artificial Sequence
  VP8* aa21-240 P[8] SP(IgE) w/o glyco CDS opt
auggacuggaccuggauccuguuccucguggccgccgcgacccgcguccacagcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1329 - RNA, 717 nt, Artificial Sequence
  VP8* aa21-240 P[8]-VirWa SP(IgE) w/o glyco CDS opt
auggacuggaccuggauccuguuccucguggccgccgcgacccgcguccacagcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1330 - RNA, 735 nt, Artificial Sequence
  VP8* aa21-240 P[4] SP(CD5) w/o glyco CDS opt
augcccaugggcagccugcagccgcucgccacccuguaccugcucgggaugcugguggccuccugccugggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1331 - RNA, 735 nt, Artificial Sequence
  VP8* aa21-240 P[6] SP(CD5) w/o glyco CDS opt
augcccaugggcagccugcagccgcucgccacccuguaccugcucgggaugcugguggccuccugccugggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1332 - RNA, 735 nt, Artificial Sequence
  VP8* aa21-240 P[8] SP(CD5) w/o glyco CDS opt
augcccaugggcagccugcagccgcucgccacccuguaccugcucgggaugcugguggccuccugccugggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1333 - RNA, 735 nt, Artificial Sequence
  VP8* aa21-240 P[8]-VirWa SP(CD5) w/o glyco CDS opt
augcccaugggcagccugcagccgcucgccacccuguaccugcucgggaugcugguggccuccugccugggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1334 - RNA, 735 nt, Artificial Sequence
  VP8* aa21-240 P[4] SP(HLA-A2) w/o glyco CDS opt
auggccgugauggccccgcggacccugguccuccugcugagcggcgcgcucgcccugacccagacgugggccgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1335 - RNA, 735 nt, Artificial Sequence
  VP8* aa21-240 P[6] SP(HLA-A2) w/o glyco CDS opt
auggccgugauggccccgcggacccugguccuccugcugagcggcgcgcucgcccugacccagacgugggccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1336 - RNA, 735 nt, Artificial Sequence
  VP8* aa21-240 P[8] SP(HLA-A2) w/o glyco CDS opt
auggccgugauggccccgcggacccugguccuccugcugagcggcgcgcucgcccugacccagacgugggccgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1337 - RNA, 735 nt, Artificial Sequence
  VP8* aa21-240 P[8]-VirWa SP(HLA-A2) w/o glyco CDS opt
auggccgugauggccccgcggacccugguccuccugcugagcggcgcgcucgcccugacccagacgugggccgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1338 - RNA, 786 nt, Artificial Sequence
  VP8* aa21-240 P[4] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1339 - RNA, 786 nt, Artificial Sequence
  VP8* aa21-240 P[6] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1340 - RNA, 786 nt, Artificial Sequence
  VP8* aa21-240 P[8] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1341 - RNA, 786 nt, Artificial Sequence
  VP8* aa21-240 P[8]-VirWa SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1342 - RNA, 777 nt, Artificial Sequence
  VP8* aa21-240 P[4] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1343 - RNA, 777 nt, Artificial Sequence
  VP8* aa21-240 P[6] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1344 - RNA, 777 nt, Artificial Sequence
  VP8* aa21-240 P[8] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1345 - RNA, 777 nt, Artificial Sequence
  VP8* aa21-240 P[8]-VirWa SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1346 - RNA, 777 nt, Artificial Sequence
  VP8* aa21-240 P[4] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1347 - RNA, 777 nt, Artificial Sequence
  VP8* aa21-240 P[6] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1348 - RNA, 777 nt, Artificial Sequence
  VP8* aa21-240 P[8] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1349 - RNA, 777 nt, Artificial Sequence
  VP8* aa21-240 P[8]-VirWa SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1350 - RNA, 795 nt, Artificial Sequence
  VP8* aa21-240 P[4] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1351 - RNA, 795 nt, Artificial Sequence
  VP8* aa21-240 P[6] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1352 - RNA, 795 nt, Artificial Sequence
  VP8* aa21-240 P[8] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1353 - RNA, 795 nt, Artificial Sequence
  VP8* aa21-240 P[8]-VirWa SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1354 - RNA, 795 nt, Artificial Sequence
  VP8* aa21-240 P[4] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcuga

SEQ ID NO: 1355 - RNA, 795 nt, Artificial Sequence
  VP8* aa21-240 P[6] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1356 - RNA, 795 nt, Artificial Sequence
  VP8* aa21-240 P[8] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcuga

SEQ ID NO: 1357 - RNA, 795 nt, Artificial Sequence
  VP8* aa21-240 P[8]-VirWa SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcuga

SEQ ID NO: 1358 - RNA, 555 nt, Artificial Sequence
  VP8* aa41-223P[4] CDS opt
auggcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1359 - RNA, 555 nt, Artificial Sequence
  VP8* aa41-223P[6] CDS opt
auggcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1360 - RNA, 555 nt, Artificial Sequence
  VP8* aa41-223P[8] CDS opt
auggcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1361 - RNA, 555 nt, Artificial Sequence
  VP8* aa41-223P[8]-VirWaCDS opt
auggcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1362 - RNA, 615 nt, Artificial Sequence
  VP8* aa41-223P[4] P2+Linker CDS opt
augcaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1363 - RNA, 615 nt, Artificial Sequence
  VP8* aa41-223P[6] P2+Linker CDS opt
augcaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1364 - RNA, 615 nt, Artificial Sequence
  VP8* aa41-223P[8] P2+Linker CDS opt
augcaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1365 - RNA, 615 nt, Artificial Sequence
  VP8* aa41-223P[8]-VirWa P2+Linker CDS opt
augcaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1366 - RNA, 615 nt, Artificial Sequence
  VP8* aa41-223P[4] SP(TPA) CDS opt
auggacgccaugaagcgcggccugugcugcgugcuccugcugugcggggccgucuucgugagcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1367 - RNA, 615 nt, Artificial Sequence
  VP8* aa41-223P[6] SP(TPA) CDS opt
auggacgccaugaagcgcggccugugcugcgugcuccugcugugcggggccgucuucgugagcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1368 - RNA, 615 nt, Artificial Sequence
  VP8* aa41-223P[8] SP(TPA) CDS opt
auggacgccaugaagcgcggccugugcugcgugcuccugcugugcggggccgucuucgugagcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1369 - RNA, 615 nt, Artificial Sequence
  VP8* aa41-223P[8]-VirWa SP(TPA) CDS opt
auggacgccaugaagcgcggccugugcugcgugcuccugcugugcggggccgucuucgugagcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1370 - RNA, 606 nt, Artificial Sequence
  VP8* aa41-223P[4] SP(HSA) CDS opt
augaagugggugaccuucaucagccugcucuuccuguucuccagcgccuacuccgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1371 - RNA, 606 nt, Artificial Sequence
  VP8* aa41-223P[6] SP(HSA) CDS opt
augaagugggugaccuucaucagccugcucuuccuguucuccagcgccuacuccgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1372 - RNA, 606 nt, Artificial Sequence
  VP8* aa41-223P[8] SP(HSA) CDS opt
augaagugggugaccuucaucagccugcucuuccuguucuccagcgccuacuccgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1373 - RNA, 606 nt, Artificial Sequence
  VP8* aa41-223P[8]-VirWa SP(HSA) CDS opt
augaagugggugaccuucaucagccugcucuuccuguucuccagcgccuacuccgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1374 - RNA, 606 nt, Artificial Sequence
  VP8* aa41-223P[4] SP(IgE) CDS opt
auggacuggaccuggauccuguuccucguggccgccgcgacccgcguccacagcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1375 - RNA, 606 nt, Artificial Sequence
  VP8* aa41-223P[6] SP(IgE) CDS opt
auggacuggaccuggauccuguuccucguggccgccgcgacccgcguccacagcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1376 - RNA, 606 nt, Artificial Sequence
  VP8* aa41-223P[8] SP(IgE) CDS opt
auggacuggaccuggauccuguuccucguggccgccgcgacccgcguccacagcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1377 - RNA, 606 nt, Artificial Sequence
  VP8* aa41-223P[8]-VirWa SP(IgE) CDS opt
auggacuggaccuggauccuguuccucguggccgccgcgacccgcguccacagcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1378 - RNA, 624 nt, Artificial Sequence
  VP8* aa41-223P[4] SP(CD5) CDS opt
augcccaugggcagccugcagccgcucgccacccuguaccugcucgggaugcugguggccuccugccugggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1379 - RNA, 624 nt, Artificial Sequence
  VP8* aa41-223P[6] SP(CD5) CDS opt
augcccaugggcagccugcagccgcucgccacccuguaccugcucgggaugcugguggccuccugccugggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1380 - RNA, 624 nt, Artificial Sequence
  VP8* aa41-223P[8] SP(CD5) CDS opt
augcccaugggcagccugcagccgcucgccacccuguaccugcucgggaugcugguggccuccugccugggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1381 - RNA, 624 nt, Artificial Sequence
  VP8* aa41-223P[8]-VirWa SP(CD5) CDS opt
augcccaugggcagccugcagccgcucgccacccuguaccugcucgggaugcugguggccuccugccugggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1382 - RNA, 624 nt, Artificial Sequence
  VP8* aa41-223P[4] SP(HLA-A2) CDS opt
auggccgugauggccccgcggacccugguccuccugcugagcggcgcgcucgcccugacccagacgugggccgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1383 - RNA, 624 nt, Artificial Sequence
  VP8* aa41-223P[6] SP(HLA-A2) CDS opt
auggccgugauggccccgcggacccugguccuccugcugagcggcgcgcucgcccugacccagacgugggccgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1384 - RNA, 624 nt, Artificial Sequence
  VP8* aa41-223P[8] SP(HLA-A2) CDS opt
auggccgugauggccccgcggacccugguccuccugcugagcggcgcgcucgcccugacccagacgugggccgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1385 - RNA, 624 nt, Artificial Sequence
  VP8* aa41-223P[8]-VirWa SP(HLA-A2) CDS opt
auggccgugauggccccgcggacccugguccuccugcugagcggcgcgcucgcccugacccagacgugggccgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1386 - RNA, 675 nt, Artificial Sequence
  VP8* aa41-223P[4] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1387 - RNA, 675 nt, Artificial Sequence
  VP8* aa41-223P[6] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1388 - RNA, 675 nt, Artificial Sequence
  VP8* aa41-223P[8] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1389 - RNA, 675 nt, Artificial Sequence
  VP8* aa41-223P[8]-VirWa SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1390 - RNA, 666 nt, Artificial Sequence
  VP8* aa41-223P[4] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1391 - RNA, 666 nt, Artificial Sequence
  VP8* aa41-223P[6] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1392 - RNA, 666 nt, Artificial Sequence
  VP8* aa41-223P[8] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1393 - RNA, 666 nt, Artificial Sequence
  VP8* aa41-223P[8]-VirWa SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1394 - RNA, 666 nt, Artificial Sequence
  VP8* aa41-223P[4] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1395 - RNA, 666 nt, Artificial Sequence
  VP8* aa41-223P[6] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1396 - RNA, 666 nt, Artificial Sequence
  VP8* aa41-223P[8] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1397 - RNA, 666 nt, Artificial Sequence
  VP8* aa41-223P[8]-VirWa SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1398 - RNA, 684 nt, Artificial Sequence
  VP8* aa41-223P[4] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1399 - RNA, 684 nt, Artificial Sequence
  VP8* aa41-223P[6] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1400 - RNA, 684 nt, Artificial Sequence
  VP8* aa41-223P[8] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1401 - RNA, 684 nt, Artificial Sequence
  VP8* aa41-223P[8]-VirWa SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1402 - RNA, 684 nt, Artificial Sequence
  VP8* aa41-223P[4] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1403 - RNA, 684 nt, Artificial Sequence
  VP8* aa41-223P[6] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1404 - RNA, 684 nt, Artificial Sequence
  VP8* aa41-223P[8] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1405 - RNA, 684 nt, Artificial Sequence
  VP8* aa41-223P[8]-VirWa SP(HLA-A2)+P2Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1406 - RNA, 555 nt, Artificial Sequence
  VP8* aa41-223P[4] w/o glyco CDS opt
auggcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1407 - RNA, 555 nt, Artificial Sequence
  VP8* aa41-223P[6] w/o glyco CDS opt
auggcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1408 - RNA, 555 nt, Artificial Sequence
  VP8* aa41-223P[8] w/o glyco CDS opt
auggcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1409 - RNA, 555 nt, Artificial Sequence
  VP8* aa41-223P[8]-VirWa w/o glyco CDS opt
auggcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1410 - RNA, 615 nt, Artificial Sequence
  VP8* aa41-223P[4] P2+Linker w/o glyco CDS opt
augcaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1411 - RNA, 615 nt, Artificial Sequence
  VP8* aa41-223P[6] P2+Linker w/o glyco CDS opt
augcaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1412 - RNA, 615 nt, Artificial Sequence
  VP8* aa41-223P[8] P2+Linker w/o glyco CDS opt
augcaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1413 - RNA, 615 nt, Artificial Sequence
  VP8* aa41-223P[8]-VirWa P2+Linker w/o glyco CDS opt
augcaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1414 - RNA, 615 nt, Artificial Sequence
  VP8* aa41-223P[4] SP(TPA) w/o glyco CDS opt
auggacgccaugaagcgcggccugugcugcgugcuccugcugugcggggccgucuucgugagcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1415 - RNA, 615 nt, Artificial Sequence
  VP8* aa41-223P[6] SP(TPA) w/o glyco CDS opt
auggacgccaugaagcgcggccugugcugcgugcuccugcugugcggggccgucuucgugagcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1416 - RNA, 615 nt, Artificial Sequence
  VP8* aa41-223P[8] SP(TPA) w/o glyco CDS opt
auggacgccaugaagcgcggccugugcugcgugcuccugcugugcggggccgucuucgugagcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1417 - RNA, 615 nt, Artificial Sequence
  VP8* aa41-223P[8]-VirWa SP(TPA) w/o glyco CDS opt
auggacgccaugaagcgcggccugugcugcgugcuccugcugugcggggccgucuucgugagcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1418 - RNA, 606 nt, Artificial Sequence
  VP8* aa41-223P[4] SP(HSA) w/o glyco CDS opt
augaagugggugaccuucaucagccugcucuuccuguucuccagcgccuacuccgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1419 - RNA, 606 nt, Artificial Sequence
  VP8* aa41-223P[6] SP(HSA) w/o glyco CDS opt
augaagugggugaccuucaucagccugcucuuccuguucuccagcgccuacuccgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1420 - RNA, 606 nt, Artificial Sequence
  VP8* aa41-223P[8] SP(HSA) w/o glyco CDS opt
augaagugggugaccuucaucagccugcucuuccuguucuccagcgccuacuccgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1421 - RNA, 606 nt, Artificial Sequence
  VP8* aa41-223P[8]-VirWa SP(HSA) w/o glyco CDS opt
augaagugggugaccuucaucagccugcucuuccuguucuccagcgccuacuccgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1422 - RNA, 606 nt, Artificial Sequence
  VP8* aa41-223P[4] SP(IgE) w/o glyco CDS opt
auggacuggaccuggauccuguuccucguggccgccgcgacccgcguccacagcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1423 - RNA, 606 nt, Artificial Sequence
  VP8* aa41-223P[6] SP(IgE) w/o glyco CDS opt
auggacuggaccuggauccuguuccucguggccgccgcgacccgcguccacagcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1424 - RNA, 606 nt, Artificial Sequence
  VP8* aa41-223P[8] SP(IgE) w/o glyco CDS opt
auggacuggaccuggauccuguuccucguggccgccgcgacccgcguccacagcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1425 - RNA, 606 nt, Artificial Sequence
  VP8* aa41-223P[8]-VirWa SP(IgE) w/o glyco CDS opt
auggacuggaccuggauccuguuccucguggccgccgcgacccgcguccacagcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1426 - RNA, 624 nt, Artificial Sequence
  VP8* aa41-223P[4] SP(CD5) w/o glyco CDS opt
augcccaugggcagccugcagccgcucgccacccuguaccugcucgggaugcugguggccuccugccugggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1427 - RNA, 624 nt, Artificial Sequence
  VP8* aa41-223P[6] SP(CD5) w/o glyco CDS opt
augcccaugggcagccugcagccgcucgccacccuguaccugcucgggaugcugguggccuccugccugggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1428 - RNA, 624 nt, Artificial Sequence
  VP8* aa41-223P[8] SP(CD5) w/o glyco CDS opt
augcccaugggcagccugcagccgcucgccacccuguaccugcucgggaugcugguggccuccugccugggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1429 - RNA, 624 nt, Artificial Sequence
  VP8* aa41-223P[8]-VirWa SP(CD5) w/o glyco CDS opt
augcccaugggcagccugcagccgcucgccacccuguaccugcucgggaugcugguggccuccugccugggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1430 - RNA, 624 nt, Artificial Sequence
  VP8* aa41-223P[4] SP(HLA-A2) w/o glyco CDS opt
auggccgugauggccccgcggacccugguccuccugcugagcggcgcgcucgcccugacccagacgugggccgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1431 - RNA, 624 nt, Artificial Sequence
  VP8* aa41-223P[6] SP(HLA-A2) w/o glyco CDS opt
auggccgugauggccccgcggacccugguccuccugcugagcggcgcgcucgcccugacccagacgugggccgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1432 - RNA, 624 nt, Artificial Sequence
  VP8* aa41-223P[8] SP(HLA-A2) w/o glyco CDS opt
auggccgugauggccccgcggacccugguccuccugcugagcggcgcgcucgcccugacccagacgugggccgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1433 - RNA, 624 nt, Artificial Sequence
  VP8* aa41-223P[8]-VirWa SP(HLA-A2) w/o glyco CDS opt
auggccgugauggccccgcggacccugguccuccugcugagcggcgcgcucgcccugacccagacgugggccgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1434 - RNA, 675 nt, Artificial Sequence
  VP8* aa41-223P[4] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1435 - RNA, 675 nt, Artificial Sequence
  VP8* aa41-223P[6] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1436 - RNA, 675 nt, Artificial Sequence
  VP8* aa41-223P[8] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1437 - RNA, 675 nt, Artificial Sequence
  VP8* aa41-223P[8]-VirWa SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1438 - RNA, 666 nt, Artificial Sequence
  VP8* aa41-223P[4] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1439 - RNA, 666 nt, Artificial Sequence
  VP8* aa41-223P[6] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1440 - RNA, 666 nt, Artificial Sequence
  VP8* aa41-223P[8] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1441 - RNA, 666 nt, Artificial Sequence
  VP8* aa41-223P[8]-VirWa SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1442 - RNA, 666 nt, Artificial Sequence
  VP8* aa41-223P[4] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1443 - RNA, 666 nt, Artificial Sequence
  VP8* aa41-223P[6] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1444 - RNA, 666 nt, Artificial Sequence
  VP8* aa41-223P[8] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1445 - RNA, 666 nt, Artificial Sequence
  VP8* aa41-223P[8]-VirWa SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1446 - RNA, 684 nt, Artificial Sequence
  VP8* aa41-223P[4] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1447 - RNA, 684 nt, Artificial Sequence
  VP8* aa41-223P[6] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1448 - RNA, 684 nt, Artificial Sequence
  VP8* aa41-223P[8] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1449 - RNA, 684 nt, Artificial Sequence
  VP8* aa41-223 P[8]-VirWa SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1450 - RNA, 684 nt, Artificial Sequence
  VP8* aa41-223P[4] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1451 - RNA, 684 nt, Artificial Sequence
  VP8* aa41-223 P[6] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1452 - RNA, 684 nt, Artificial Sequence
  VP8* aa41-223 P[8] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1453 - RNA, 684 nt, Artificial Sequence
  VP8* aa41-223P[8]-VirWa SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1454 - RNA, 483 nt, Artificial Sequence
  VP8* aa65-223short P[4] CDS opt
augcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1455 - RNA, 483 nt, Artificial Sequence
  VP8* aa65-223short P[6] CDS opt
augcucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1456 - RNA, 483 nt, Artificial Sequence
  VP8* aa65-223 short P[8] CDS opt
augcucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1457 - RNA, 483 nt, Artificial Sequence
  VP8* aa65-223short P[8]-VirWaCDS opt
augcucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1458 - RNA, 543 nt, Artificial Sequence
  VP8* aa65-223short P[4] P2+Linker CDS opt
augcaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1459 - RNA, 543 nt, Artificial Sequence
  VP8* aa65-223short P[6] P2+Linker CDS opt
augcaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1460 - RNA, 543 nt, Artificial Sequence
  VP8* aa65-223 short P[8] P2+Linker CDS opt
augcaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1461 - RNA, 543 nt, Artificial Sequence
  VP8* aa65-223short P[8]-VirWa P2+Linker CDS opt
augcaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1462 - RNA, 543 nt, Artificial Sequence
  VP8* aa65-223short P[4] SP(TPA) CDS opt
auggacgccaugaagcgcggccugugcugcgugcuccugcugugcggggccgucuucgugagccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1463 - RNA, 543 nt, Artificial Sequence
  VP8* aa65-223short P[6] SP(TPA) CDS opt
auggacgccaugaagcgcggccugugcugcgugcuccugcugugcggggccgucuucgugagccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1464 - RNA, 543 nt, Artificial Sequence
  VP8* aa65-223 short P[8] SP(TPA) CDS opt
auggacgccaugaagcgcggccugugcugcgugcuccugcugugcggggccgucuucgugagccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1465 - RNA, 543 nt, Artificial Sequence
  VP8* aa65-223short P[8]-VirWa SP(TPA) CDS opt
auggacgccaugaagcgcggccugugcugcgugcuccugcugugcggggccgucuucgugagccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1466 - RNA, 534 nt, Artificial Sequence
  VP8* aa65-223short P[4] SP(HSA) CDS opt
augaagugggugaccuucaucagccugcucuuccuguucuccagcgccuacucccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1467 - RNA, 534 nt, Artificial Sequence
  VP8* aa65-223short P[6] SP(HSA) CDS opt
augaagugggugaccuucaucagccugcucuuccuguucuccagcgccuacucccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1468 - RNA, 534 nt, Artificial Sequence
  VP8* aa65-223 short P[8] SP(HSA) CDS opt
augaagugggugaccuucaucagccugcucuuccuguucuccagcgccuacucccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1469 - RNA, 534 nt, Artificial Sequence
  VP8* aa65-223short P[8]-VirWa SP(HSA) CDS opt
augaagugggugaccuucaucagccugcucuuccuguucuccagcgccuacucccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1470 - RNA, 534 nt, Artificial Sequence
  VP8* aa65-223short P[4] SP(IgE) CDS opt
auggacuggaccuggauccuguuccucguggccgccgcgacccgcguccacagccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1471 - RNA, 534 nt, Artificial Sequence
  VP8* aa65-223shortP[6]SP(IgE) CDS opt
auggacuggaccuggauccuguuccucguggccgccgcgacccgcguccacagccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1472 - RNA, 534 nt, Artificial Sequence
  VP8* aa65-223 short P[8] SP(IgE) CDS opt
auggacuggaccuggauccuguuccucguggccgccgcgacccgcguccacagccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1473 - RNA, 534 nt, Artificial Sequence
  VP8* aa65-223short P[8]-VirWa SP(IgE) CDS opt
auggacuggaccuggauccuguuccucguggccgccgcgacccgcguccacagccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1474 - RNA, 552 nt, Artificial Sequence
  VP8* aa65-223short P[4] SP(CD5) CDS opt
augcccaugggcagccugcagccgcucgccacccuguaccugcucgggaugcugguggccuccugccugggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1475 - RNA, 552 nt, Artificial Sequence
  VP8* aa65-223short P[6] SP(CD5) CDS opt
augcccaugggcagccugcagccgcucgccacccuguaccugcucgggaugcugguggccuccugccugggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1476 - RNA, 552 nt, Artificial Sequence
  VP8* aa65-223 short P[8] SP(CD5) CDS opt
augcccaugggcagccugcagccgcucgccacccuguaccugcucgggaugcugguggccuccugccugggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1477 - RNA, 552 nt, Artificial Sequence
  VP8* aa65-223short P[8]-VirWa SP(CD5) CDS opt
augcccaugggcagccugcagccgcucgccacccuguaccugcucgggaugcugguggccuccugccugggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1478 - RNA, 552 nt, Artificial Sequence
  VP8* aa65-223short P[4] SP(HLA-A2) CDS opt
auggccgugauggccccgcggacccugguccuccugcugagcggcgcgcucgcccugacccagacgugggcccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1479 - RNA, 552 nt, Artificial Sequence
  VP8* aa65-223short P[6] SP(HLA-A2) CDS opt
auggccgugauggccccgcggacccugguccuccugcugagcggcgcgcucgcccugacccagacgugggcccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1480 - RNA, 552 nt, Artificial Sequence
  VP8* aa65-223 short P[8] SP(HLA-A2) CDS opt
auggccgugauggccccgcggacccugguccuccugcugagcggcgcgcucgcccugacccagacgugggcccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1481 - RNA, 552 nt, Artificial Sequence
  VP8* aa65-223short P[8]-VirWa SP(HLA-A2) CDS opt
auggccgugauggccccgcggacccugguccuccugcugagcggcgcgcucgcccugacccagacgugggcccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1482 - RNA, 603 nt, Artificial Sequence
  VP8* aa65-223short P[4] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1483 - RNA, 603 nt, Artificial Sequence
  VP8* aa65-223short P[6] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1484 - RNA, 603 nt, Artificial Sequence
  VP8* aa65-223 short P[8] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1485 - RNA, 603 nt, Artificial Sequence
  VP8* aa65-223short P[8]-VirWa SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1486 - RNA, 594 nt, Artificial Sequence
  VP8* aa65-223short P[4] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1487 - RNA, 594 nt, Artificial Sequence
  VP8* aa65-223short P[6] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1488 - RNA, 594 nt, Artificial Sequence
  VP8* aa65-223 short P[8] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1489 - RNA, 594 nt, Artificial Sequence
  VP8* aa65-223short P[8]-VirWa SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1490 - RNA, 594 nt, Artificial Sequence
  VP8* aa65-223short P[4] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1491 - RNA, 594 nt, Artificial Sequence
  VP8* aa65-223short P[6] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1492 - RNA, 594 nt, Artificial Sequence
  VP8* aa65-223 short P[8] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1493 - RNA, 594 nt, Artificial Sequence
  VP8* aa65-223short P[8]-VirWa SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1494 - RNA, 612 nt, Artificial Sequence
  VP8* aa65-223short P[4] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1495 - RNA, 612 nt, Artificial Sequence
  VP8* aa65-223short P[6] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1496 - RNA, 612 nt, Artificial Sequence
  VP8* aa65-223 short P[8] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1497 - RNA, 612 nt, Artificial Sequence
  VP8* aa65-223short P[8]-VirWa SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1498 - RNA, 612 nt, Artificial Sequence
  VP8* aa65-223short P[4] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1499 - RNA, 612 nt, Artificial Sequence
  VP8* aa65-223short P[6] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1500 - RNA, 612 nt, Artificial Sequence
  VP8* aa65-223 short P[8] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1501 - RNA, 612 nt, Artificial Sequence
  VP8* aa65-223short P[8]-VirWa SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1502 - RNA, 483 nt, Artificial Sequence
  VP8* aa65-223short P[4] w/o glyco CDS opt
augcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1503 - RNA, 483 nt, Artificial Sequence
  VP8* aa65-223short P[6] w/o glyco CDS opt
augcucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1504 - RNA, 483 nt, Artificial Sequence
  VP8* aa65-223 short P[8] w/o glyco CDS opt
augcucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1505 - RNA, 483 nt, Artificial Sequence
  VP8* aa65-223short P[8]-VirWa w/o glyco CDS opt
augcucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1506 - RNA, 543 nt, Artificial Sequence
  VP8* aa65-223short P[4] P2+Linker w/o glyco CDS opt
augcaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1507 - RNA, 543 nt, Artificial Sequence
  VP8* aa65-223short P[6] P2+Linker w/o glyco CDS opt
augcaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1508 - RNA, 543 nt, Artificial Sequence
  VP8* aa65-223 short P[8] P2+Linker w/o glyco CDS opt
augcaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1509 - RNA, 543 nt, Artificial Sequence
  VP8* aa65-223short P[8]-VirWa P2+Linker w/o glyco CDS opt
augcaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1510 - RNA, 543 nt, Artificial Sequence
  VP8* aa65-223short P[4] SP(TPA) w/o glyco CDS opt
auggacgccaugaagcgcggccugugcugcgugcuccugcugugcggggccgucuucgugagccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1511 - RNA, 543 nt, Artificial Sequence
  VP8* aa65-223short P[6] SP(TPA) w/o glyco CDS opt
auggacgccaugaagcgcggccugugcugcgugcuccugcugugcggggccgucuucgugagccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1512 - RNA, 543 nt, Artificial Sequence
  VP8* aa65-223 short P[8] SP(TPA) w/o glyco CDS opt
auggacgccaugaagcgcggccugugcugcgugcuccugcugugcggggccgucuucgugagccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1513 - RNA, 543 nt, Artificial Sequence
  VP8* aa65-223short P[8]-VirWa SP(TPA) w/o glyco CDS opt
auggacgccaugaagcgcggccugugcugcgugcuccugcugugcggggccgucuucgugagccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1514 - RNA, 534 nt, Artificial Sequence
  VP8* aa65-223short P[4] SP(HSA) w/o glyco CDS opt
augaagugggugaccuucaucagccugcucuuccuguucuccagcgccuacucccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1515 - RNA, 534 nt, Artificial Sequence
  VP8* aa65-223short P[6] SP(HSA) w/o glyco CDS opt
augaagugggugaccuucaucagccugcucuuccuguucuccagcgccuacucccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1516 - RNA, 534 nt, Artificial Sequence
  VP8* aa65-223 short P[8] SP(HSA) w/o glyco CDS opt
augaagugggugaccuucaucagccugcucuuccuguucuccagcgccuacucccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1517 - RNA, 534 nt, Artificial Sequence
  VP8* aa65-223short P[8]-VirWa SP(HSA) w/o glyco CDS opt
augaagugggugaccuucaucagccugcucuuccuguucuccagcgccuacucccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1518 - RNA, 534 nt, Artificial Sequence
  VP8* aa65-223short P[4] SP(IgE) w/o glyco CDS opt
auggacuggaccuggauccuguuccucguggccgccgcgacccgcguccacagccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1519 - RNA, 534 nt, Artificial Sequence
  VP8* aa65-223short P[6] SP(IgE) w/o glyco CDS opt
auggacuggaccuggauccuguuccucguggccgccgcgacccgcguccacagccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1520 - RNA, 534 nt, Artificial Sequence
  VP8* aa65-223 short P[8] SP(IgE) w/o glyco CDS opt
auggacuggaccuggauccuguuccucguggccgccgcgacccgcguccacagccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1521 - RNA, 534 nt, Artificial Sequence
  VP8* aa65-223short P[8]-VirWa SP(IgE) w/o glyco CDS opt
auggacuggaccuggauccuguuccucguggccgccgcgacccgcguccacagccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1522 - RNA, 552 nt, Artificial Sequence
  VP8* aa65-223short P[4] SP(CD5) w/o glyco CDS opt
augcccaugggcagccugcagccgcucgccacccuguaccugcucgggaugcugguggccuccugccugggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1523 - RNA, 552 nt, Artificial Sequence
  VP8* aa65-223short P[6] SP(CD5) w/o glyco CDS opt
augcccaugggcagccugcagccgcucgccacccuguaccugcucgggaugcugguggccuccugccugggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1524 - RNA, 552 nt, Artificial Sequence
  VP8* aa65-223 short P[8] SP(CD5) w/o glyco CDS opt
augcccaugggcagccugcagccgcucgccacccuguaccugcucgggaugcugguggccuccugccugggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1525 - RNA, 552 nt, Artificial Sequence
  VP8* aa65-223short P[8]-VirWa SP(CD5) w/o glyco CDS opt
augcccaugggcagccugcagccgcucgccacccuguaccugcucgggaugcugguggccuccugccugggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1526 - RNA, 552 nt, Artificial Sequence
  VP8* aa65-223short P[4] SP(HLA-A2) w/o glyco CDS opt
auggccgugauggccccgcggacccugguccuccugcugagcggcgcgcucgcccugacccagacgugggcccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1527 - RNA, 552 nt, Artificial Sequence
  VP8* aa65-223short P[6] SP(HLA-A2) w/o glyco CDS opt
auggccgugauggccccgcggacccugguccuccugcugagcggcgcgcucgcccugacccagacgugggcccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1528 - RNA, 552 nt, Artificial Sequence
  VP8* aa65-223 short P[8] SP(HLA-A2) w/o glyco CDS opt
auggccgugauggccccgcggacccugguccuccugcugagcggcgcgcucgcccugacccagacgugggcccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1529 - RNA, 552 nt, Artificial Sequence
  VP8* aa65-223short P[8]-VirWa SP(HLA-A2) w/o glyco CDS opt
auggccgugauggccccgcggacccugguccuccugcugagcggcgcgcucgcccugacccagacgugggcccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1530 - RNA, 603 nt, Artificial Sequence
  VP8* aa65-223short P[4] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1531 - RNA, 603 nt, Artificial Sequence
  VP8* aa65-223short P[6] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1532 - RNA, 603 nt, Artificial Sequence
  VP8* aa65-223 short P[8] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1533 - RNA, 603 nt, Artificial Sequence
  VP8* aa65-223short P[8]-VirWa SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1534 - RNA, 594 nt, Artificial Sequence
  VP8* aa65-223short P[4] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1535 - RNA, 594 nt, Artificial Sequence
  VP8* aa65-223short P[6] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1536 - RNA, 594 nt, Artificial Sequence
  VP8* aa65-223 short P[8] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1537 - RNA, 594 nt, Artificial Sequence
  VP8* aa65-223short P[8]-VirWa SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1538 - RNA, 594 nt, Artificial Sequence
  VP8* aa65-223short P[4] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1539 - RNA, 594 nt, Artificial Sequence
  VP8* aa65-223short P[6] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1540 - RNA, 594 nt, Artificial Sequence
  VP8* aa65-223 short P[8] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1541 - RNA, 594 nt, Artificial Sequence
  VP8* aa65-223short P[8]-VirWa SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1542 - RNA, 612 nt, Artificial Sequence
  VP8* aa65-223short P[4] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1543 - RNA, 612 nt, Artificial Sequence
  VP8* aa65-223short P[6] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1544 - RNA, 612 nt, Artificial Sequence
  VP8* aa65-223 short P[8] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1545 - RNA, 612 nt, Artificial Sequence
  VP8* aa65-223short P[8]-VirWa SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1546 - RNA, 612 nt, Artificial Sequence
  VP8* aa65-223short P[4] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1547 - RNA, 612 nt, Artificial Sequence
  VP8* aa65-223short P[6] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1548 - RNA, 612 nt, Artificial Sequence
  VP8* aa65-223 short P[8] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccuguga

SEQ ID NO: 1549 - RNA, 612 nt, Artificial Sequence
  VP8* aa65-223short P[8]-VirWa SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcuguga

SEQ ID NO: 1550 - RNA, 486 nt, Artificial Sequence
  VP8* aa64-223short P[4] CDS opt
auggugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1551 - RNA, 486 nt, Artificial Sequence
  VP8* aa64-223short P[6] CDS opt
augguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1552 - RNA, 546 nt, Artificial Sequence
  VP8* aa64-223short P[4] P2+Linker CDS opt
augcaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1553 - RNA, 546 nt, Artificial Sequence
  VP8* aa64-223short P[6] P2+Linker CDS opt
augcaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1554 - RNA, 546 nt, Artificial Sequence
  VP8* aa64-223short P[4] SP(TPA) CDS opt
auggacgccaugaagcgcggccugugcugcgugcuccugcugugcggggccgucuucgugagcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1555 - RNA, 546 nt, Artificial Sequence
  VP8* aa64-223short P[6] SP(TPA) CDS opt
auggacgccaugaagcgcggccugugcugcgugcuccugcugugcggggccgucuucgugagcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1556 - RNA, 537 nt, Artificial Sequence
  VP8* aa64-223short P[4] SP(HSA) CDS opt
augaagugggugaccuucaucagccugcucuuccuguucuccagcgccuacuccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1557 - RNA, 537 nt, Artificial Sequence
  VP8* aa64-223short P[6] SP(HSA) CDS opt
augaagugggugaccuucaucagccugcucuuccuguucuccagcgccuacuccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1558 - RNA, 537 nt, Artificial Sequence
  VP8* aa64-223short P[4] SP(IgE) CDS opt
auggacuggaccuggauccuguuccucguggccgccgcgacccgcguccacagcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1559 - RNA, 537 nt, Artificial Sequence
  VP8* aa64-223short P[6] SP(IgE) CDS opt
auggacuggaccuggauccuguuccucguggccgccgcgacccgcguccacagcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1560 - RNA, 555 nt, Artificial Sequence
  VP8* aa64-223short P[4] SP(CD5) CDS opt
augcccaugggcagccugcagccgcucgccacccuguaccugcucgggaugcugguggccuccugccugggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1561 - RNA, 555 nt, Artificial Sequence
  VP8* aa64-223short P[6] SP(CD5) CDS opt
augcccaugggcagccugcagccgcucgccacccuguaccugcucgggaugcugguggccuccugccugggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1562 - RNA, 555 nt, Artificial Sequence
  VP8* aa64-223short P[4] SP(HLA-A2) CDS opt
auggccgugauggccccgcggacccugguccuccugcugagcggcgcgcucgcccugacccagacgugggccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1563 - RNA, 555 nt, Artificial Sequence
  VP8* aa64-223short P[6] SP(HLA-A2) CDS opt
auggccgugauggccccgcggacccugguccuccugcugagcggcgcgcucgcccugacccagacgugggccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1564 - RNA, 606 nt, Artificial Sequence
  VP8* aa64-223short P[4] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1565 - RNA, 606 nt, Artificial Sequence
  VP8* aa64-223short P[6] SP(TPA)+P2+Linker CDS opt
auggacgccaugaagcgcggccugugcugcgugcuccugcugugcggggccgucuucgugagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1566 - RNA, 597 nt, Artificial Sequence
  VP8* aa64-223short P[4] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1567 - RNA, 597 nt, Artificial Sequence
  VP8* aa64-223short P[6] SP(HSA)+P2+Linker CDS opt
augaagugggugaccuucaucagccugcucuuccuguucuccagcgccuacucccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1568 - RNA, 597 nt, Artificial Sequence
  VP8* aa64-223short P[4] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1569 - RNA, 597 nt, Artificial Sequence
  VP8* aa64-223short P[6] SP(IgE)+P2+Linker CDS opt
auggacuggaccuggauccuguuccucguggccgccgcgacccgcguccacagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1570 - RNA, 615 nt, Artificial Sequence
  VP8* aa64-223short P[4] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1571 - RNA, 615 nt, Artificial Sequence
  VP8* aa64-223short P[6] SP(CD5)+P2+Linker CDS opt
augcccaugggcagccugcagccgcucgccacccuguaccugcucgggaugcugguggccuccugccugggccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1572 - RNA, 615 nt, Artificial Sequence
  VP8* aa64-223short P[4] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1573 - RNA, 615 nt, Artificial Sequence
  VP8* aa64-223short P[6] SP(HLA-A2)+P2+Linker CDS opt
auggccgugauggccccgcggacccugguccuccugcugagcggcgcgcucgcccugacccagacgugggcccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1574 - RNA, 486 nt, Artificial Sequence
  VP8* aa64-223short P[4] w/o glyco CDS opt
auggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1575 - RNA, 486 nt, Artificial Sequence
  VP8* aa64-223short P[6] w/o glyco CDS opt
augguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1576 - RNA, 546 nt, Artificial Sequence
  VP8* aa64-223short P[4] P2+Linker w/o glyco CDS opt
augcaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1577 - RNA, 546 nt, Artificial Sequence
  VP8* aa64-223short P[6] P2+Linker w/o glyco CDS opt
augcaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1578 - RNA, 546 nt, Artificial Sequence
  VP8* aa64-223short P[4] SP(TPA) w/o glyco CDS opt
auggacgccaugaagcgcggccugugcugcgugcuccugcugugcggggccgucuucgugagcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1579 - RNA, 546 nt, Artificial Sequence
  VP8* aa64-223short P[6] SP(TPA) w/o glyco CDS opt
auggacgccaugaagcgcggccugugcugcgugcuccugcugugcggggccgucuucgugagcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1580 - RNA, 537 nt, Artificial Sequence
  VP8* aa64-223short P[4] SP(HSA) w/o glyco CDS opt
augaagugggugaccuucaucagccugcucuuccuguucuccagcgccuacuccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1581 - RNA, 537 nt, Artificial Sequence
  VP8* aa64-223short P[6] SP(HSA) w/o glyco CDS opt
augaagugggugaccuucaucagccugcucuuccuguucuccagcgccuacuccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1582 - RNA, 537 nt, Artificial Sequence
  VP8* aa64-223short P[4] SP(IgE) w/o glyco CDS opt
auggacuggaccuggauccuguuccucguggccgccgcgacccgcguccacagcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1583 - RNA, 537 nt, Artificial Sequence
  VP8* aa64-223short P[6] SP(IgE) w/o glyco CDS opt
auggacuggaccuggauccuguuccucguggccgccgcgacccgcguccacagcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1584 - RNA, 555 nt, Artificial Sequence
  VP8* aa64-223short P[4] SP(CD5) w/o glyco CDS opt
augcccaugggcagccugcagccgcucgccacccuguaccugcucgggaugcugguggccuccugccugggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1585 - RNA, 555 nt, Artificial Sequence
  VP8* aa64-223short P[6] SP(CD5) w/o glyco CDS opt
augcccaugggcagccugcagccgcucgccacccuguaccugcucgggaugcugguggccuccugccugggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1586 - RNA, 555 nt, Artificial Sequence
  VP8* aa64-223short P[4] SP(HLA-A2) w/o glyco CDS opt
auggccgugauggccccgcggacccugguccuccugcugagcggcgcgcucgcccugacccagacgugggccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1587 - RNA, 555 nt, Artificial Sequence
  VP8* aa64-223short P[6] SP(HLA-A2) w/o glyco CDS opt
auggccgugauggccccgcggacccugguccuccugcugagcggcgcgcucgcccugacccagacgugggccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1588 - RNA, 606 nt, Artificial Sequence
  VP8* aa64-223short P[4] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1589 - RNA, 606 nt, Artificial Sequence
  VP8* aa64-223short P[6] SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1590 - RNA, 597 nt, Artificial Sequence
  VP8* aa64-223short P[4] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1591 - RNA, 597 nt, Artificial Sequence
  VP8* aa64-223short P[6] SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1592 - RNA, 597 nt, Artificial Sequence
  VP8* aa64-223short P[4] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1593 - RNA, 597 nt, Artificial Sequence
  VP8* aa64-223short P[6] SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1594 - RNA, 615 nt, Artificial Sequence
  VP8* aa64-223short P[4] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1595 - RNA, 615 nt, Artificial Sequence
  VP8* aa64-223short P[6] SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1596 - RNA, 615 nt, Artificial Sequence
  VP8* aa64-223short P[4] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcuguga

SEQ ID NO: 1597 - RNA, 615 nt, Artificial Sequence
  VP8* aa64-223short P[6] SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1598 - RNA, 768 nt, Artificial Sequence
  P2 VP8* P[4]-long CDS opt
augcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1599 - RNA, 768 nt, Artificial Sequence
  P2 VP8* P[6]-long CDS opt
augcaguacaucaaggccaacagcaaguucaucggcaucaccgagcuggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1600 - RNA, 768 nt, Artificial Sequence
  P2 VP8* P[8]-long CDS opt
augcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1601 - RNA, 531 nt, Artificial Sequence
  P2 VP8* P[4]-short CDS opt
augcaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcuguga

SEQ ID NO: 1602 - RNA, 531 nt, Artificial Sequence
  P2 VP8* P[6]-short CDS opt
augcaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1603 - RNA, 528 nt, Artificial Sequence
  P2 VP8* P[8]-short CDS opt
augcaguacaucaaggccaacagcaaguucaucggcaucaccgagcugcucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1604 - RNA, 528 nt, Artificial Sequence
  P2 VP8* P[8]-WA-VirWa-short CDS opt
augcaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcuguga

SEQ ID NO: 1605 - RNA, 828 nt, Artificial Sequence
  SP P2 VP8* P[4]-long w/o glyco CDS opt
auggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1606 - RNA, 828 nt, Artificial Sequence
  SP P2 VP8* P[6]-long w/o glyco CDS opt
auggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1607 - RNA, 828 nt, Artificial Sequence
  SP P2 VP8* P[8]-long w/o glyco CDS opt
auggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1608 - RNA, 591 nt, Artificial Sequence
  SP P2 VP8* P[4]-short w/o glyco CDS opt
auggacgccaugaagcgcggccugugcugcgugcuccugcugugcggggccgucuucgugagccaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcuguga

SEQ ID NO: 1609 - RNA, 591 nt, Artificial Sequence
  SP P2 VP8* P[6]-short w/o glyco CDS opt
auggacgccaugaagcgcggccugugcugcgugcuccugcugugcggggccgucuucgugagccaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1610 - RNA, 588 nt, Artificial Sequence
  SP P2 VP8* P[8]-short w/o glyco CDS opt
auggacgccaugaagcgcggccugugcugcgugcuccugcugugcggggccgucuucgugagccaguacaucaaggccaacagcaaguucaucggcaucaccgagcugcucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1611 - RNA, 588 nt, Artificial Sequence
  SP P2 VP8* P[8]-WA-VirWa-short w/o glyco CDS opt
auggacgccaugaagcgcggccugugcugcgugcuccugcugugcggggccgucuucgugagccaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgcagaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaacaacgggcuguga

SEQ ID NO: 1612 - RNA, 966 nt, Artificial Sequence
  SP P2 VP8* P[4]-long w/o glyco w TM domain CDS opt
auggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 1613 - RNA, 966 nt, Artificial Sequence
  SP P2 VP8* P[6]-long w/o glyco w TM domain CDS opt
auggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 1614 - RNA, 966 nt, Artificial Sequence
  SP P2 VP8* P[8]-long w/o glyco w TM domain CDS opt
auggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 1615 - RNA, 729 nt, Artificial Sequence
  SP P2 VP8* P[4]-short w/o glyco w TM domain CDS opt
auggacgccaugaagcgcggccugugcugcgugcuccugcugugcggggccgucuucgugagccaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 1616 - RNA, 729 nt, Artificial Sequence
  SP P2 VP8* P[6]-short w/o glyco w TM domain CDS opt
auggacgccaugaagcgcggccugugcugcgugcuccugcugugcggggccgucuucgugagccaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 1617 - RNA, 726 nt, Artificial Sequence
  SP P2 VP8* P[8]-short w/o glyco w TM domain CDS opt
auggacgccaugaagcgcggccugugcugcgugcuccugcugugcggggccgucuucgugagccaguacaucaaggccaacagcaaguucaucggcaucaccgagcugcucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 1618 - RNA, 726 nt, Artificial Sequence
  SP P2 VP8* P[8]-WA-VirWa-short w/o glyco w TM domain CDS opt
auggacgccaugaagcgcggccugugcugcgugcuccugcugugcggggccgucuucgugagccaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgcagaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaacaacgggcugaagcucgaguccacgcggaucuaccagauccuggcgaucuacagcaccgucgccagcucccuggugcucguggucagccugggggccaucuccuucuggaugugcagcaacggcucccugcagugccgcaucugcaucuga

SEQ ID NO: 1619 - RNA, 1302 nt, Artificial Sequence
  SP VLP peptide linker P2 VP8* P[4]-long w/o glyco CDS opt
auggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcuga

SEQ ID NO: 1620 - RNA, 1302 nt, Artificial Sequence
  SP VLP peptide linker P2 VP8* P[6]-long w/o glyco CDS opt
auggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcuga

SEQ ID NO: 1621 - RNA, 1302 nt, Artificial Sequence
  SP VLP peptide linker P2 VP8* P[8]-long w/o glyco CDS opt
auggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcuga

SEQ ID NO: 1622 - RNA, 1065 nt, Artificial Sequence
  SP VLP peptide linker P2 VP8* P[4]-short w/o glyco CDS opt
auggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcuguga

SEQ ID NO: 1623 - RNA, 1065 nt, Artificial Sequence
  SP VLP peptide linker P2 VP8* P[6]-short w/o glyco CDS opt
auggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcuguga

SEQ ID NO: 1624 - RNA, 1062 nt, Artificial Sequence
  SP VLP peptide linker P2 VP8* P[8]-short w/o glyco CDS opt
auggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcugcucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccuguga

SEQ ID NO: 1625 - RNA, 1062 nt, Artificial Sequence
  SP VLP peptide linker P2 VP8* P[8]-Wa-VirWa-short w/o glyco CDS opt
auggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgcagaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaacaacgggcuguga

SEQ ID NO: 1626 - RNA, 940 nt, Artificial Sequence
  VP8* aa2-240 long P[4] mRNA opt Design1
gggagaaagcuuaccauggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1627 - RNA, 940 nt, Artificial Sequence
  VP8* aa2-240 long P[6] mRNA opt Design1
gggagaaagcuuaccauggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1628 - RNA, 940 nt, Artificial Sequence
  VP8* aa2-240 long P[8] mRNA opt Design1
gggagaaagcuuaccauggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1629 - RNA, 940 nt, Artificial Sequence
  VP8* aa2-240 long P[8]-VirWa mRNA opt Design1
gggagaaagcuuaccauggccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1630 - RNA, 1000 nt, Artificial Sequence
  VP8* aa2-240 long P[4] P2+Linker mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1631 - RNA, 1000 nt, Artificial Sequence
  VP8* aa2-240 long P[6] P2+Linker mRNA opt Design1
gggagaaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1632 - RNA, 1000 nt, Artificial Sequence
  VP8* aa2-240 long P[8] P2+Linker mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1633 - RNA, 1000 nt, Artificial Sequence
  VP8* aa2-240 long P[8]-VirWa P2+Linker mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1634 - RNA, 1000 nt, Artificial Sequence
  VP8* aa2-240 long P[4] SP(TPA) mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1635 - RNA, 1000 nt, Artificial Sequence
  VP8* aa2-240 long P[6] SP(TPA) mRNA opt Design1
gggagaaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1636 - RNA, 1000 nt, Artificial Sequence
  VP8* aa2-240 long P[8] SP(TPA) mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1637 - RNA, 1000 nt, Artificial Sequence
  VP8* aa2-240 long P[8]-VirWa SP(TPA) mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1638 - RNA, 991 nt, Artificial Sequence
  VP8* aa2-240 long P[4] SP(HSA) mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1639 - RNA, 991 nt, Artificial Sequence
  VP8* aa2-240 long P[6] SP(HSA) mRNA opt Design1
gggagaaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1640 - RNA, 991 nt, Artificial Sequence
  VP8* aa2-240 long P[8] SP(HSA) mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1641 - RNA, 991 nt, Artificial Sequence
  VP8* aa2-240 long P[8]-VirWa SP(HSA) mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1642 - RNA, 991 nt, Artificial Sequence
  VP8* aa2-240 long P[4] SP(IgE) mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1643 - RNA, 991 nt, Artificial Sequence
  VP8* aa2-240 long P[6] SP(IgE) mRNA opt Design1
gggagaaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1644 - RNA, 991 nt, Artificial Sequence
  VP8* aa2-240 long P[8] SP(IgE) mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1645 - RNA, 991 nt, Artificial Sequence
  VP8* aa2-240 long P[8]-VirWa SP(IgE) mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1646 - RNA, 1009 nt, Artificial Sequence
  VP8* aa2-240 long P[4] SP(CD5) mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1647 - RNA, 1009 nt, Artificial Sequence
  VP8* aa2-240 long P[6] SP(CD5) mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1648 - RNA, 1009 nt, Artificial Sequence
  VP8* aa2-240 long P[8] SP(CD5) mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1649 - RNA, 1009 nt, Artificial Sequence
  VP8* aa2-240 long P[8]-VirWa SP(CD5) mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1650 - RNA, 1009 nt, Artificial Sequence
  VP8* aa2-240 long P[4] SP(HLA-A2) mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1651 - RNA, 1009 nt, Artificial Sequence
  VP8* aa2-240 long P[6] SP(HLA-A2) mRNA opt Design1
gggagaaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1652 - RNA, 1009 nt, Artificial Sequence
  VP8* aa2-240 long P[8] SP(HLA-A2) mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1653 - RNA, 1009 nt, Artificial Sequence
  VP8* aa2-240 long P[8]-VirWa SP(HLA-A2) mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1654 - RNA, 1060 nt, Artificial Sequence
  VP8* aa2-240 long P[4] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1655 - RNA, 1060 nt, Artificial Sequence
  VP8* aa2-240 long P[6] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1656 - RNA, 1060 nt, Artificial Sequence
  VP8* aa2-240 long P[8] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1657 - RNA, 1060 nt, Artificial Sequence
  VP8* aa2-240 long P[8]-VirWa SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1658 - RNA, 1051 nt, Artificial Sequence
  VP8* aa2-240 long P[4] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1659 - RNA, 1051 nt, Artificial Sequence
  VP8* aa2-240 long P[6] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1660 - RNA, 1051 nt, Artificial Sequence
  VP8* aa2-240 long P[8] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1661 - RNA, 1051 nt, Artificial Sequence
  VP8* aa2-240 long P[8]-VirWa SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1662 - RNA, 1051 nt, Artificial Sequence
  VP8* aa2-240 long P[4] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1663 - RNA, 1051 nt, Artificial Sequence
  VP8* aa2-240 long P[6] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1664 - RNA, 1051 nt, Artificial Sequence
  VP8* aa2-240 long P[8] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1665 - RNA, 1051 nt, Artificial Sequence
  VP8* aa2-240 long P[8]-VirWa SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1666 - RNA, 1069 nt, Artificial Sequence
  VP8* aa2-240 long P[4] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1667 - RNA, 1069 nt, Artificial Sequence
  VP8* aa2-240 long P[6] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1668 - RNA, 1069 nt, Artificial Sequence
  VP8* aa2-240 long P[8] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1669 - RNA, 1069 nt, Artificial Sequence
  VP8* aa2-240 long P[8]-VirWa SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1670 - RNA, 1069 nt, Artificial Sequence
  VP8* aa2-240 long P[4] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1671 - RNA, 1069 nt, Artificial Sequence
  VP8* aa2-240 long P[6] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1672 - RNA, 1069 nt, Artificial Sequence
  VP8* aa2-240 long P[8] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1673 - RNA, 1069 nt, Artificial Sequence
  VP8* aa2-240 long P[8]-VirWa SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1674 - RNA, 940 nt, Artificial Sequence
  VP8* aa2-240 long P[4] w/o glyco mRNA opt Design1
gggagaaagcuuaccauggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1675 - RNA, 940 nt, Artificial Sequence
  VP8* aa2-240 long P[6] w/o glyco mRNA opt Design1
gggagaaagcuuaccauggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1676 - RNA, 940 nt, Artificial Sequence
  VP8* aa2-240 long P[8] w/o glyco mRNA opt Design1
gggagaaagcuuaccauggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1677 - RNA, 940 nt, Artificial Sequence
  VP8* aa2-240 long P[8]-VirWa w/o glyco mRNA opt Design1
gggagaaagcuuaccauggccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1678 - RNA, 1000 nt, Artificial Sequence
  VP8* aa2-240 long P[4] P2+Linker w/o glyco mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1679 - RNA, 1000 nt, Artificial Sequence
  VP8* aa2-240 long P[6] P2+Linker w/o glyco mRNA opt Design1
gggagaaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1680 - RNA, 1000 nt, Artificial Sequence
  VP8* aa2-240 long P[8] P2+Linker w/o glyco mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1681 - RNA, 1000 nt, Artificial Sequence
  VP8* aa2-240 long P[8]-VirWa P2+Linker w/o glyco mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1682 - RNA, 1000 nt, Artificial Sequence
  VP8* aa2-240 long P[4] SP(TPA) w/o glyco mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1683 - RNA, 1000 nt, Artificial Sequence
  VP8* aa2-240 long P[6] SP(TPA) w/o glyco mRNA opt Design1
gggagaaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1684 - RNA, 1000 nt, Artificial Sequence
  VP8* aa2-240 long P[8] SP(TPA) w/o glyco mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1685 - RNA, 1000 nt, Artificial Sequence
  VP8* aa2-240 long P[8]-VirWa SP(TPA) w/o glyco mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1686 - RNA, 991 nt, Artificial Sequence
  VP8* aa2-240 long P[4] SP(HSA) w/o glyco mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1687 - RNA, 991 nt, Artificial Sequence
  VP8* aa2-240 long P[6] SP(HSA) w/o glyco mRNA opt Design1
gggagaaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1688 - RNA, 991 nt, Artificial Sequence
  VP8* aa2-240 long P[8] SP(HSA) w/o glyco mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1689 - RNA, 991 nt, Artificial Sequence
  VP8* aa2-240 long P[8]-VirWa SP(HSA) w/o glyco mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1690 - RNA, 991 nt, Artificial Sequence
  VP8* aa2-240 long P[4] SP(IgE) w/o glyco mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1691 - RNA, 991 nt, Artificial Sequence
  VP8* aa2-240 long P[6] SP(IgE) w/o glyco mRNA opt Design1
gggagaaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1692 - RNA, 991 nt, Artificial Sequence
  VP8* aa2-240 long P[8] SP(IgE) w/o glyco mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1693 - RNA, 991 nt, Artificial Sequence
  VP8* aa2-240 long P[8]-VirWa SP(IgE) w/o glyco mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1694 - RNA, 1009 nt, Artificial Sequence
  VP8* aa2-240 long P[4] SP(CD5) w/o glyco mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1695 - RNA, 1009 nt, Artificial Sequence
  VP8* aa2-240 long P[6] SP(CD5) w/o glyco mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1696 - RNA, 1009 nt, Artificial Sequence
  VP8* aa2-240 long P[8] SP(CD5) w/o glyco mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1697 - RNA, 1009 nt, Artificial Sequence
  VP8* aa2-240 long P[8]-VirWa SP(CD5) w/o glyco mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1698 - RNA, 1009 nt, Artificial Sequence
  VP8* aa2-240 long P[4] SP(HLA-A2) w/o glyco mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1699 - RNA, 1009 nt, Artificial Sequence
  VP8* aa2-240 long P[6] SP(HLA-A2) w/o glyco mRNA opt Design1
gggagaaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1700 - RNA, 1009 nt, Artificial Sequence
  VP8* aa2-240 long P[8] SP(HLA-A2) w/o glyco mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1701 - RNA, 1009 nt, Artificial Sequence
  VP8* aa2-240 long P[8]-VirWa SP(HLA-A2) w/o glyco mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1702 - RNA, 1060 nt, Artificial Sequence
  VP8* aa2-240 long P[4] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1703 - RNA, 1060 nt, Artificial Sequence
  VP8* aa2-240 long P[6] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1704 - RNA, 1060 nt, Artificial Sequence
  VP8* aa2-240 long P[8] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1705 - RNA, 1060 nt, Artificial Sequence
  VP8* aa2-240 long P[8]-VirWa SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1706 - RNA, 1051 nt, Artificial Sequence
  VP8* aa2-240 long P[4] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1707 - RNA, 1051 nt, Artificial Sequence
  VP8* aa2-240 long P[6] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1708 - RNA, 1051 nt, Artificial Sequence
  VP8* aa2-240 long P[8] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1709 - RNA, 1051 nt, Artificial Sequence
  VP8* aa2-240 long P[8]-VirWa SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1710 - RNA, 1051 nt, Artificial Sequence
  VP8* aa2-240 long P[4] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1711 - RNA, 1051 nt, Artificial Sequence
  VP8* aa2-240 long P[6] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1712 - RNA, 1051 nt, Artificial Sequence
  VP8* aa2-240 long P[8] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1713 - RNA, 1051 nt, Artificial Sequence
  VP8* aa2-240 long P[8]-VirWa SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1714 - RNA, 1069 nt, Artificial Sequence
  VP8* aa2-240 long P[4] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1715 - RNA, 1069 nt, Artificial Sequence
  VP8* aa2-240 long P[6] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1716 - RNA, 1069 nt, Artificial Sequence
  VP8* aa2-240 long P[8] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1717 - RNA, 1069 nt, Artificial Sequence
  VP8* aa2-240 long P[8]-VirWa SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1718 - RNA, 1069 nt, Artificial Sequence
  VP8* aa2-240 long P[4] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1719 - RNA, 1069 nt, Artificial Sequence
  VP8* aa2-240 long P[6] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1720 - RNA, 1069 nt, Artificial Sequence
  VP8* aa2-240 long P[8] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1721 - RNA, 1069 nt, Artificial Sequence
  VP8* aa2-240 long P[8]-VirWa SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1722 - RNA, 910 nt, Artificial Sequence
  VP8* aa2-230 P[4] mRNA opt Design1
gggagaaagcuuaccauggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1723 - RNA, 910 nt, Artificial Sequence
  VP8* aa2-230 P[6] mRNA opt Design1
gggagaaagcuuaccauggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1724 - RNA, 910 nt, Artificial Sequence
  VP8* aa2-230 P[8] mRNA opt Design1
gggagaaagcuuaccauggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1725 - RNA, 910 nt, Artificial Sequence
  VP8* aa2-230 P[8]-VirWa mRNA opt Design1
gggagaaagcuuaccauggccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1726 - RNA, 970 nt, Artificial Sequence
  VP8* aa2-230 P[4] P2+Linker mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1727 - RNA, 970 nt, Artificial Sequence
  VP8* aa2-230 P[6] P2+Linker mRNA opt Design1
gggagaaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1728 - RNA, 970 nt, Artificial Sequence
  VP8* aa2-230 P[8] P2+Linker mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1729 - RNA, 970 nt, Artificial Sequence
  VP8* aa2-230 P[8]-VirWa P2+Linker mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1730 - RNA, 970 nt, Artificial Sequence
  VP8* aa2-230 P[4] SP(TPA) mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1731 - RNA, 970 nt, Artificial Sequence
  VP8* aa2-230 P[6] SP(TPA) mRNA opt Design1
gggagaaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1732 - RNA, 970 nt, Artificial Sequence
  VP8* aa2-230 P[8] SP(TPA) mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1733 - RNA, 970 nt, Artificial Sequence
  VP8* aa2-230 P[8]-VirWa SP(TPA) mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1734 - RNA, 961 nt, Artificial Sequence
  VP8* aa2-230 P[4] SP(HSA) mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1735 - RNA, 961 nt, Artificial Sequence
  VP8* aa2-230 P[6] SP(HSA) mRNA opt Design1
gggagaaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1736 - RNA, 961 nt, Artificial Sequence
  VP8* aa2-230 P[8] SP(HSA) mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1737 - RNA, 961 nt, Artificial Sequence
  VP8* aa2-230 P[8]-VirWa SP(HSA) mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1738 - RNA, 961 nt, Artificial Sequence
  VP8* aa2-230 P[4] SP(IgE) mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1739 - RNA, 961 nt, Artificial Sequence
  VP8* aa2-230 P[6] SP(IgE) mRNA opt Design1
gggagaaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1740 - RNA, 961 nt, Artificial Sequence
  VP8* aa2-230 P[8] SP(IgE) mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1741 - RNA, 961 nt, Artificial Sequence
  VP8* aa2-230 P[8]-VirWa SP(IgE) mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1742 - RNA, 979 nt, Artificial Sequence
  VP8* aa2-230 P[4] SP(CD5) mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1743 - RNA, 979 nt, Artificial Sequence
  VP8* aa2-230 P[6] SP(CD5) mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1744 - RNA, 979 nt, Artificial Sequence
  VP8* aa2-230 P[8] SP(CD5) mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1745 - RNA, 979 nt, Artificial Sequence
  VP8* aa2-230 P[8]-VirWa SP(CD5) mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1746 - RNA, 979 nt, Artificial Sequence
  VP8* aa2-230 P[4] SP(HLA-A2) mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1747 - RNA, 979 nt, Artificial Sequence
  VP8* aa2-230 P[6] SP(HLA-A2) mRNA opt Design1
gggagaaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1748 - RNA, 979 nt, Artificial Sequence
  VP8* aa2-230 P[8] SP(HLA-A2) mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1749 - RNA, 979 nt, Artificial Sequence
  VP8* aa2-230 P[8]-VirWa SP(HLA-A2) mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1750 - RNA, 1030 nt, Artificial Sequence
  VP8* aa2-230 P[4] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1751 - RNA, 1030 nt, Artificial Sequence
  VP8* aa2-230 P[6] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1752 - RNA, 1030 nt, Artificial Sequence
  VP8* aa2-230 P[8] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1753 - RNA, 1030 nt, Artificial Sequence
  VP8* aa2-230 P[8]-VirWa SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1754 - RNA, 1021 nt, Artificial Sequence
  VP8* aa2-230 P[4] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1755 - RNA, 1021 nt, Artificial Sequence
  VP8* aa2-230 P[6] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1756 - RNA, 1021 nt, Artificial Sequence
  VP8* aa2-230 P[8] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1757 - RNA, 1021 nt, Artificial Sequence
  VP8* aa2-230 P[8]-VirWa SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1758 - RNA, 1021 nt, Artificial Sequence
  VP8* aa2-230 P[4] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1759 - RNA, 1021 nt, Artificial Sequence
  VP8* aa2-230 P[6] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1760 - RNA, 1021 nt, Artificial Sequence
  VP8* aa2-230 P[8] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1761 - RNA, 1021 nt, Artificial Sequence
  VP8* aa2-230 P[8]-VirWa SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1762 - RNA, 1039 nt, Artificial Sequence
  VP8* aa2-230 P[4] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1763 - RNA, 1039 nt, Artificial Sequence
  VP8* aa2-230 P[6] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1764 - RNA, 1039 nt, Artificial Sequence
  VP8* aa2-230 P[8] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1765 - RNA, 1039 nt, Artificial Sequence
  VP8* aa2-230 P[8]-VirWa SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1766 - RNA, 1039 nt, Artificial Sequence
  VP8* aa2-230 P[4] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1767 - RNA, 1039 nt, Artificial Sequence
  VP8* aa2-230 P[6] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1768 - RNA, 1039 nt, Artificial Sequence
  VP8* aa2-230 P[8] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1769 - RNA, 1039 nt, Artificial Sequence
  VP8* aa2-230 P[8]-VirWa SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1770 - RNA, 910 nt, Artificial Sequence
  VP8* aa2-230 P[4] w/o glyco mRNA opt Design1
gggagaaagcuuaccauggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1771 - RNA, 910 nt, Artificial Sequence
  VP8* aa2-230 P[6] w/o glyco mRNA opt Design1
gggagaaagcuuaccauggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1772 - RNA, 910 nt, Artificial Sequence
  VP8* aa2-230 P[8] w/o glyco mRNA opt Design1
gggagaaagcuuaccauggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1773 - RNA, 910 nt, Artificial Sequence
  VP8* aa2-230 P[8]-VirWa w/o glyco mRNA opt Design1
gggagaaagcuuaccauggccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1774 - RNA, 970 nt, Artificial Sequence
  VP8* aa2-230 P[4] P2+Linker w/o glyco mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1775 - RNA, 970 nt, Artificial Sequence
  VP8* aa2-230 P[6] P2+Linker w/o glyco mRNA opt Design1
gggagaaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1776 - RNA, 970 nt, Artificial Sequence
  VP8* aa2-230 P[8] P2+Linker w/o glyco mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1777 - RNA, 970 nt, Artificial Sequence
  VP8* aa2-230 P[8]-VirWa P2+Linker w/o glyco mRNA opt Design1
gggagaaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1778 - RNA, 970 nt, Artificial Sequence
  VP8* aa2-230 P[4] SP(TPA) w/o glyco mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1779 - RNA, 970 nt, Artificial Sequence
  VP8* aa2-230 P[6] SP(TPA) w/o glyco mRNA opt Design1
gggagaaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1780 - RNA, 970 nt, Artificial Sequence
  VP8* aa2-230 P[8] SP(TPA) w/o glyco mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1781 - RNA, 970 nt, Artificial Sequence
  VP8* aa2-230 P[8]-VirWa SP(TPA) w/o glyco mRNA opt Design1
gggagaaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1782 - RNA, 961 nt, Artificial Sequence
  VP8* aa2-230 P[4] SP(HSA) w/o glyco mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1783 - RNA, 961 nt, Artificial Sequence
  VP8* aa2-230 P[6] SP(HSA) w/o glyco mRNA opt Design1
gggagaaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1784 - RNA, 961 nt, Artificial Sequence
  VP8* aa2-230 P[8] SP(HSA) w/o glyco mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1785 - RNA, 961 nt, Artificial Sequence
  VP8* aa2-230 P[8]-VirWa SP(HSA) w/o glyco mRNA opt Design1
gggagaaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1786 - RNA, 961 nt, Artificial Sequence
  VP8* aa2-230 P[4] SP(IgE) w/o glyco mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1787 - RNA, 961 nt, Artificial Sequence
  VP8* aa2-230 P[6] SP(IgE) w/o glyco mRNA opt Design1
gggagaaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1788 - RNA, 961 nt, Artificial Sequence
  VP8* aa2-230 P[8] SP(IgE) w/o glyco mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1789 - RNA, 961 nt, Artificial Sequence
  VP8* aa2-230 P[8]-VirWa SP(IgE) w/o glyco mRNA opt Design1
gggagaaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1790 - RNA, 979 nt, Artificial Sequence
  VP8* aa2-230 P[4] SP(CD5) w/o glyco mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1791 - RNA, 979 nt, Artificial Sequence
  VP8* aa2-230 P[6] SP(CD5) w/o glyco mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1792 - RNA, 979 nt, Artificial Sequence
  VP8* aa2-230 P[8] SP(CD5) w/o glyco mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1793 - RNA, 979 nt, Artificial Sequence
  VP8* aa2-230 P[8]-VirWa SP(CD5) w/o glyco mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1794 - RNA, 979 nt, Artificial Sequence
  VP8* aa2-230 P[4] SP(HLA-A2) w/o glyco mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1795 - RNA, 979 nt, Artificial Sequence
  VP8* aa2-230 P[6] SP(HLA-A2) w/o glyco mRNA opt Design1
gggagaaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1796 - RNA, 979 nt, Artificial Sequence
  VP8* aa2-230 P[8] SP(HLA-A2) w/o glyco mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1797 - RNA, 979 nt, Artificial Sequence
  VP8* aa2-230 P[8]-VirWa SP(HLA-A2) w/o glyco mRNA opt Design1
gggagaaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1798 - RNA, 1030 nt, Artificial Sequence
  VP8* aa2-230 P[4] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1799 - RNA, 1030 nt, Artificial Sequence
  VP8* aa2-230 P[6] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1800 - RNA, 1030 nt, Artificial Sequence
  VP8* aa2-230 P[8] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1801 - RNA, 1030 nt, Artificial Sequence
  VP8* aa2-230 P[8]-VirWa SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1802 - RNA, 1021 nt, Artificial Sequence
  VP8* aa2-230 P[4] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1803 - RNA, 1021 nt, Artificial Sequence
  VP8* aa2-230 P[6] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1804 - RNA, 1021 nt, Artificial Sequence
  VP8* aa2-230 P[8] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1805 - RNA, 1021 nt, Artificial Sequence
  VP8* aa2-230 P[8]-VirWa SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1806 - RNA, 1021 nt, Artificial Sequence
  VP8* aa2-230 P[4] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1807 - RNA, 1021 nt, Artificial Sequence
  VP8* aa2-230 P[6] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1808 - RNA, 1021 nt, Artificial Sequence
  VP8* aa2-230 P[8] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1809 - RNA, 1021 nt, Artificial Sequence
  VP8* aa2-230 P[8]-VirWa SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1810 - RNA, 1039 nt, Artificial Sequence
  VP8* aa2-230 P[4] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1811 - RNA, 1039 nt, Artificial Sequence
  VP8* aa2-230 P[6] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1812 - RNA, 1039 nt, Artificial Sequence
  VP8* aa2-230 P[8] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1813 - RNA, 1039 nt, Artificial Sequence
  VP8* aa2-230 P[8]-VirWa SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1814 - RNA, 1039 nt, Artificial Sequence
  VP8* aa2-230 P[4] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1815 - RNA, 1039 nt, Artificial Sequence
  VP8* aa2-230 P[6] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1816 - RNA, 1039 nt, Artificial Sequence
  VP8* aa2-230 P[8] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1817 - RNA, 1039 nt, Artificial Sequence
  VP8* aa2-230 P[8]-VirWa SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1818 - RNA, 862 nt, Artificial Sequence
  VP8* aa11-223 P[4] mRNA opt Design1
gggagaaagcuuaccaugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1819 - RNA, 862 nt, Artificial Sequence
  VP8* aa11-223 P[6] mRNA opt Design1
gggagaaagcuuaccaugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1820 - RNA, 862 nt, Artificial Sequence
  VP8* aa11-223 P[8] mRNA opt Design1
gggagaaagcuuaccaugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1821 - RNA, 862 nt, Artificial Sequence
  VP8* aa11-223 P[8]-VirWa mRNA opt Design1
gggagaaagcuuaccaugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1822 - RNA, 922 nt, Artificial Sequence
  VP8* aa11-223 P[4] P2+Linker mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1823 - RNA, 922 nt, Artificial Sequence
  VP8* aa11-223 P[6] P2+Linker mRNA opt Design1
gggagaaagcuuaccaugcaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1824 - RNA, 922 nt, Artificial Sequence
  VP8* aa11-223 P[8] P2+Linker mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1825 - RNA, 922 nt, Artificial Sequence
  VP8* aa11-223 P[8]-VirWa P2+Linker mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1826 - RNA, 922 nt, Artificial Sequence
  VP8* aa11-223 P[4] SP(TPA) mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1827 - RNA, 922 nt, Artificial Sequence
  VP8* aa11-223 P[6] SP(TPA) mRNA opt Design1
gggagaaagcuuaccauggacgccaugaagcgcggccugugcugcgugcuccugcugugcggggccgucuucgugagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1828 - RNA, 922 nt, Artificial Sequence
  VP8* aa11-223 P[8] SP(TPA) mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1829 - RNA, 922 nt, Artificial Sequence
  VP8* aa11-223 P[8]-VirWa SP(TPA) mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1830 - RNA, 913 nt, Artificial Sequence
  VP8* aa11-223 P[4] SP(HSA) mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1831 - RNA, 913 nt, Artificial Sequence
  VP8* aa11-223 P[6] SP(HSA) mRNA opt Design1
gggagaaagcuuaccaugaagugggugaccuucaucagccugcucuuccuguucuccagcgccuacuccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1832 - RNA, 913 nt, Artificial Sequence
  VP8* aa11-223 P[8] SP(HSA) mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1833 - RNA, 913 nt, Artificial Sequence
  VP8* aa11-223 P[8]-VirWa SP(HSA) mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1834 - RNA, 913 nt, Artificial Sequence
  VP8* aa11-223 P[4] SP(IgE) mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1835 - RNA, 913 nt, Artificial Sequence
  VP8* aa11-223 P[6] SP(IgE) mRNA opt Design1
gggagaaagcuuaccauggacuggaccuggauccuguuccucguggccgccgcgacccgcguccacagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1836 - RNA, 913 nt, Artificial Sequence
  VP8* aa11-223 P[8] SP(IgE) mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1837 - RNA, 913 nt, Artificial Sequence
  VP8* aa11-223 P[8]-VirWa SP(IgE) mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1838 - RNA, 931 nt, Artificial Sequence
  VP8* aa11-223 P[4] SP(CD5) mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1839 - RNA, 931 nt, Artificial Sequence
  VP8* aa11-223 P[6] SP(CD5) mRNA opt Design1
gggagaaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1840 - RNA, 931 nt, Artificial Sequence
  VP8* aa11-223 P[8] SP(CD5) mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1841 - RNA, 931 nt, Artificial Sequence
  VP8* aa11-223 P[8]-VirWa SP(CD5) mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1842 - RNA, 931 nt, Artificial Sequence
  VP8* aa11-223 P[4] SP(HLA-A2) mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1843 - RNA, 931 nt, Artificial Sequence
  VP8* aa11-223 P[6] SP(HLA-A2) mRNA opt Design1
gggagaaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1844 - RNA, 931 nt, Artificial Sequence
  VP8* aa11-223 P[8] SP(HLA-A2) mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1845 - RNA, 931 nt, Artificial Sequence
  VP8* aa11-223 P[8]-VirWa SP(HLA-A2) mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1846 - RNA, 982 nt, Artificial Sequence
  VP8* aa11-223 P[4] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1847 - RNA, 982 nt, Artificial Sequence
  VP8* aa11-223 P[6] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1848 - RNA, 982 nt, Artificial Sequence
  VP8* aa11-223 P[8] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1849 - RNA, 982 nt, Artificial Sequence
  VP8* aa11-223 P[8]-VirWa SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1850 - RNA, 973 nt, Artificial Sequence
  VP8* aa11-223 P[4] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1851 - RNA, 973 nt, Artificial Sequence
  VP8* aa11-223 P[6] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1852 - RNA, 973 nt, Artificial Sequence
  VP8* aa11-223 P[8] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1853 - RNA, 973 nt, Artificial Sequence
  VP8* aa11-223 P[8]-VirWa SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1854 - RNA, 973 nt, Artificial Sequence
  VP8* aa11-223 P[4] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1855 - RNA, 973 nt, Artificial Sequence
  VP8* aa11-223 P[6] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1856 - RNA, 973 nt, Artificial Sequence
  VP8* aa11-223 P[8] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1857 - RNA, 973 nt, Artificial Sequence
  VP8* aa11-223 P[8]-VirWa SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1858 - RNA, 991 nt, Artificial Sequence
  VP8* aa11-223 P[4] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1859 - RNA, 991 nt, Artificial Sequence
  VP8* aa11-223 P[6] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1860 - RNA, 991 nt, Artificial Sequence
  VP8* aa11-223 P[8] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1861 - RNA, 991 nt, Artificial Sequence
  VP8* aa11-223 P[8]-VirWa SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1862 - RNA, 991 nt, Artificial Sequence
  VP8* aa11-223 P[4] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1863 - RNA, 991 nt, Artificial Sequence
  VP8* aa11-223 P[6] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1864 - RNA, 991 nt, Artificial Sequence
  VP8* aa11-223 P[8] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1865 - RNA, 991 nt, Artificial Sequence
  VP8* aa11-223 P[8]-VirWa SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1866 - RNA, 862 nt, Artificial Sequence
  VP8* aa11-223 P[4] w/o glyco mRNA opt Design1
gggagaaagcuuaccaugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1867 - RNA, 862 nt, Artificial Sequence
  VP8* aa11-223 P[6] w/o glyco mRNA opt Design1
gggagaaagcuuaccaugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1868 - RNA, 862 nt, Artificial Sequence
  VP8* aa11-223 P[8] w/o glyco mRNA opt Design1
gggagaaagcuuaccaugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1869 - RNA, 862 nt, Artificial Sequence
  VP8* aa11-223 P[8]-VirWa w/o glyco mRNA opt Design1
gggagaaagcuuaccaugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1870 - RNA, 922 nt, Artificial Sequence
  VP8* aa11-223 P[4] P2+Linker w/o glyco mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1871 - RNA, 922 nt, Artificial Sequence
  VP8* aa11-223 P[6] P2+Linker w/o glyco mRNA opt Design1
gggagaaagcuuaccaugcaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1872 - RNA, 922 nt, Artificial Sequence
  VP8* aa11-223 P[8] P2+Linker w/o glyco mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1873 - RNA, 922 nt, Artificial Sequence
  VP8* aa11-223 P[8]-VirWa P2+Linker w/o glyco mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1874 - RNA, 922 nt, Artificial Sequence
  VP8* aa11-223 P[4] SP(TPA) w/o glyco mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1875 - RNA, 922 nt, Artificial Sequence
  VP8* aa11-223 P[6] SP(TPA) w/o glyco mRNA opt Design1
gggagaaagcuuaccauggacgccaugaagcgcggccugugcugcgugcuccugcugugcggggccgucuucgugagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1876 - RNA, 922 nt, Artificial Sequence
  VP8* aa11-223 P[8] SP(TPA) w/o glyco mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1877 - RNA, 922 nt, Artificial Sequence
  VP8* aa11-223 P[8]-VirWa SP(TPA) w/o glyco mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1878 - RNA, 913 nt, Artificial Sequence
  VP8* aa11-223 P[4] SP(HSA) w/o glyco mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1879 - RNA, 913 nt, Artificial Sequence
  VP8* aa11-223 P[6] SP(HSA) w/o glyco mRNA opt Design1
gggagaaagcuuaccaugaagugggugaccuucaucagccugcucuuccuguucuccagcgccuacuccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1880 - RNA, 913 nt, Artificial Sequence
  VP8* aa11-223 P[8] SP(HSA) w/o glyco mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1881 - RNA, 913 nt, Artificial Sequence
  VP8* aa11-223 P[8]-VirWa SP(HSA) w/o glyco mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1882 - RNA, 913 nt, Artificial Sequence
  VP8* aa11-223 P[4] SP(IgE) w/o glyco mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1883 - RNA, 913 nt, Artificial Sequence
  VP8* aa11-223 P[6] SP(IgE) w/o glyco mRNA opt Design1
gggagaaagcuuaccauggacuggaccuggauccuguuccucguggccgccgcgacccgcguccacagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1884 - RNA, 913 nt, Artificial Sequence
  VP8* aa11-223 P[8] SP(IgE) w/o glyco mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1885 - RNA, 913 nt, Artificial Sequence
  VP8* aa11-223 P[8]-VirWa SP(IgE) w/o glyco mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1886 - RNA, 931 nt, Artificial Sequence
  VP8* aa11-223 P[4] SP(CD5) w/o glyco mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1887 - RNA, 931 nt, Artificial Sequence
  VP8* aa11-223 P[6] SP(CD5) w/o glyco mRNA opt Design1
gggagaaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1888 - RNA, 931 nt, Artificial Sequence
  VP8* aa11-223 P[8] SP(CD5) w/o glyco mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1889 - RNA, 931 nt, Artificial Sequence
  VP8* aa11-223 P[8]-VirWa SP(CD5) w/o glyco mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1890 - RNA, 931 nt, Artificial Sequence
  VP8* aa11-223 P[4] SP(HLA-A2) w/o glyco mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1891 - RNA, 931 nt, Artificial Sequence
  VP8* aa11-223 P[6] SP(HLA-A2) w/o glyco mRNA opt Design1
gggagaaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1892 - RNA, 931 nt, Artificial Sequence
  VP8* aa11-223 P[8] SP(HLA-A2) w/o glyco mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1893 - RNA, 931 nt, Artificial Sequence
  VP8* aa11-223 P[8]-VirWa SP(HLA-A2) w/o glyco mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1894 - RNA, 982 nt, Artificial Sequence
  VP8* aa11-223 P[4] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1895 - RNA, 982 nt, Artificial Sequence
  VP8* aa11-223 P[6] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1896 - RNA, 982 nt, Artificial Sequence
  VP8* aa11-223 P[8] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1897 - RNA, 982 nt, Artificial Sequence
  VP8* aa11-223 P[8]-VirWa SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1898 - RNA, 973 nt, Artificial Sequence
  VP8* aa11-223 P[4] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1899 - RNA, 973 nt, Artificial Sequence
  VP8* aa11-223 P[6] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1900 - RNA, 973 nt, Artificial Sequence
  VP8* aa11-223 P[8] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1901 - RNA, 973 nt, Artificial Sequence
  VP8* aa11-223 P[8]-VirWa SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1902 - RNA, 973 nt, Artificial Sequence
  VP8* aa11-223 P[4] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1903 - RNA, 973 nt, Artificial Sequence
  VP8* aa11-223 P[6] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1904 - RNA, 973 nt, Artificial Sequence
  VP8* aa11-223 P[8] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1905 - RNA, 973 nt, Artificial Sequence
  VP8* aa11-223 P[8]-VirWa SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1906 - RNA, 991 nt, Artificial Sequence
  VP8* aa11-223 P[4] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1907 - RNA, 991 nt, Artificial Sequence
  VP8* aa11-223 P[6] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1908 - RNA, 991 nt, Artificial Sequence
  VP8* aa11-223 P[8] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1909 - RNA, 991 nt, Artificial Sequence
  VP8* aa11-223 P[8]-VirWa SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1910 - RNA, 991 nt, Artificial Sequence
  VP8* aa11-223 P[4] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1911 - RNA, 991 nt, Artificial Sequence
  VP8* aa11-223 P[6] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1912 - RNA, 991 nt, Artificial Sequence
  VP8* aa11-223 P[8] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1913 - RNA, 991 nt, Artificial Sequence
  VP8* aa11-223 P[8]-VirWa SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1914 - RNA, 913 nt, Artificial Sequence
  VP8* aa11-240 P[4] mRNA opt Design1
gggagaaagcuuaccaugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1915 - RNA, 913 nt, Artificial Sequence
  VP8* aa11-240 P[6] mRNA opt Design1
gggagaaagcuuaccaugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1916 - RNA, 913 nt, Artificial Sequence
  VP8* aa11-240 P[8] mRNA opt Design1
gggagaaagcuuaccaugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1917 - RNA, 913 nt, Artificial Sequence
  VP8* aa11-240 P[8]-VirWa mRNA opt Design1
gggagaaagcuuaccaugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1918 - RNA, 973 nt, Artificial Sequence
  VP8* aa11-240 P[4] P2+Linker mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1919 - RNA, 973 nt, Artificial Sequence
  VP8* aa11-240 P[6] P2+Linker mRNA opt Design1
gggagaaagcuuaccaugcaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1920 - RNA, 973 nt, Artificial Sequence
  VP8* aa11-240 P[8] P2+Linker mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1921 - RNA, 973 nt, Artificial Sequence
  VP8* aa11-240 P[8]-VirWa P2+Linker mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1922 - RNA, 973 nt, Artificial Sequence
  VP8* aa11-240 P[4] SP(TPA) mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1923 - RNA, 973 nt, Artificial Sequence
  VP8* aa11-240 P[6] SP(TPA) mRNA opt Design1
gggagaaagcuuaccauggacgccaugaagcgcggccugugcugcgugcuccugcugugcggggccgucuucgugagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1924 - RNA, 973 nt, Artificial Sequence
  VP8* aa11-240 P[8] SP(TPA) mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1925 - RNA, 973 nt, Artificial Sequence
  VP8* aa11-240 P[8]-VirWa SP(TPA) mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1926 - RNA, 964 nt, Artificial Sequence
  VP8* aa11-240 P[4] SP(HSA) mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1927 - RNA, 964 nt, Artificial Sequence
  VP8* aa11-240 P[6] SP(HSA) mRNA opt Design1
gggagaaagcuuaccaugaagugggugaccuucaucagccugcucuuccuguucuccagcgccuacuccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1928 - RNA, 964 nt, Artificial Sequence
  VP8* aa11-240 P[8] SP(HSA) mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1929 - RNA, 964 nt, Artificial Sequence
  VP8* aa11-240 P[8]-VirWa SP(HSA) mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1930 - RNA, 964 nt, Artificial Sequence
  VP8* aa11-240 P[4] SP(IgE) mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1931 - RNA, 964 nt, Artificial Sequence
  VP8* aa11-240 P[6] SP(IgE) mRNA opt Design1
gggagaaagcuuaccauggacuggaccuggauccuguuccucguggccgccgcgacccgcguccacagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1932 - RNA, 964 nt, Artificial Sequence
  VP8* aa11-240 P[8] SP(IgE) mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1933 - RNA, 964 nt, Artificial Sequence
  VP8* aa11-240 P[8]-VirWa SP(IgE) mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1934 - RNA, 982 nt, Artificial Sequence
  VP8* aa11-240 P[4] SP(CD5) mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1935 - RNA, 982 nt, Artificial Sequence
  VP8* aa11-240 P[6] SP(CD5) mRNA opt Design1
gggagaaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1936 - RNA, 982 nt, Artificial Sequence
  VP8* aa11-240 P[8] SP(CD5) mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1937 - RNA, 982 nt, Artificial Sequence
  VP8* aa11-240 P[8]-VirWa SP(CD5) mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1938 - RNA, 982 nt, Artificial Sequence
  VP8* aa11-240 P[4] SP(HLA-A2) mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1939 - RNA, 982 nt, Artificial Sequence
  VP8* aa11-240 P[6] SP(HLA-A2) mRNA opt Design1
gggagaaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1940 - RNA, 982 nt, Artificial Sequence
  VP8* aa11-240 P[8] SP(HLA-A2) mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1941 - RNA, 982 nt, Artificial Sequence
  VP8* aa11-240 P[8]-VirWa SP(HLA-A2) mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1942 - RNA, 1033 nt, Artificial Sequence
  VP8* aa11-240 P[4] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1943 - RNA, 1033 nt, Artificial Sequence
  VP8* aa11-240 P[6] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1944 - RNA, 1033 nt, Artificial Sequence
  VP8* aa11-240 P[8] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1945 - RNA, 1033 nt, Artificial Sequence
  VP8* aa11-240 P[8]-VirWa SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1946 - RNA, 1024 nt, Artificial Sequence
  VP8* aa11-240 P[4] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1947 - RNA, 1024 nt, Artificial Sequence
  VP8* aa11-240 P[6] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1948 - RNA, 1024 nt, Artificial Sequence
  VP8* aa11-240 P[8] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1949 - RNA, 1024 nt, Artificial Sequence
  VP8* aa11-240 P[8]-VirWa SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1950 - RNA, 1024 nt, Artificial Sequence
  VP8* aa11-240 P[4] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1951 - RNA, 1024 nt, Artificial Sequence
  VP8* aa11-240 P[6] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1952 - RNA, 1024 nt, Artificial Sequence
  VP8* aa11-240 P[8] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1953 - RNA, 1024 nt, Artificial Sequence
  VP8* aa11-240 P[8]-VirWa SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1954 - RNA, 1042 nt, Artificial Sequence
  VP8* aa11-240 P[4] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1955 - RNA, 1042 nt, Artificial Sequence
  VP8* aa11-240 P[6] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1956 - RNA, 1042 nt, Artificial Sequence
  VP8* aa11-240 P[8] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1957 - RNA, 1042 nt, Artificial Sequence
  VP8* aa11-240 P[8]-VirWa SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1958 - RNA, 1042 nt, Artificial Sequence
  VP8* aa11-240 P[4] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1959 - RNA, 1042 nt, Artificial Sequence
  VP8* aa11-240 P[6] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1960 - RNA, 1042 nt, Artificial Sequence
  VP8* aa11-240 P[8] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1961 - RNA, 1042 nt, Artificial Sequence
  VP8* aa11-240 P[8]-VirWa SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1962 - RNA, 913 nt, Artificial Sequence
  VP8* aa11-240 P[4] w/o glyco mRNA opt Design1
gggagaaagcuuaccaugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1963 - RNA, 913 nt, Artificial Sequence
  VP8* aa11-240 P[6] w/o glyco mRNA opt Design1
gggagaaagcuuaccaugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1964 - RNA, 913 nt, Artificial Sequence
  VP8* aa11-240 P[8] w/o glyco mRNA opt Design1
gggagaaagcuuaccaugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1965 - RNA, 913 nt, Artificial Sequence
  VP8* aa11-240 P[8]-VirWa w/o glyco mRNA opt Design1
gggagaaagcuuaccaugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1966 - RNA, 973 nt, Artificial Sequence
  VP8* aa11-240 P[4] P2+Linker w/o glyco mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1967 - RNA, 973 nt, Artificial Sequence
  VP8* aa11-240 P[6] P2+Linker w/o glyco mRNA opt Design1
gggagaaagcuuaccaugcaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1968 - RNA, 973 nt, Artificial Sequence
  VP8* aa11-240 P[8] P2+Linker w/o glyco mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1969 - RNA, 973 nt, Artificial Sequence
  VP8* aa11-240 P[8]-VirWa P2+Linker w/o glyco mRNA opt Design1
gggagaaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1970 - RNA, 973 nt, Artificial Sequence
  VP8* aa11-240 P[4] SP(TPA) w/o glyco mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1971 - RNA, 973 nt, Artificial Sequence
  VP8* aa11-240 P[6] SP(TPA) w/o glyco mRNA opt Design1
gggagaaagcuuaccauggacgccaugaagcgcggccugugcugcgugcuccugcugugcggggccgucuucgugagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1972 - RNA, 973 nt, Artificial Sequence
  VP8* aa11-240 P[8] SP(TPA) w/o glyco mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1973 - RNA, 973 nt, Artificial Sequence
  VP8* aa11-240 P[8]-VirWa SP(TPA) w/o glyco mRNA opt Design1
gggagaaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1974 - RNA, 964 nt, Artificial Sequence
  VP8* aa11-240 P[4] SP(HSA) w/o glyco mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1975 - RNA, 964 nt, Artificial Sequence
  VP8* aa11-240 P[6] SP(HSA) w/o glyco mRNA opt Design1
gggagaaagcuuaccaugaagugggugaccuucaucagccugcucuuccuguucuccagcgccuacuccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1976 - RNA, 964 nt, Artificial Sequence
  VP8* aa11-240 P[8] SP(HSA) w/o glyco mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1977 - RNA, 964 nt, Artificial Sequence
  VP8* aa11-240 P[8]-VirWa SP(HSA) w/o glyco mRNA opt Design1
gggagaaagcuuaccaugaagugggugaccuucaucagccugcucuuccuguucuccagcgccuacuccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1978 - RNA, 964 nt, Artificial Sequence
  VP8* aa11-240 P[4] SP(IgE) w/o glyco mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1979 - RNA, 964 nt, Artificial Sequence
  VP8* aa11-240 P[6] SP(IgE) w/o glyco mRNA opt Design1
gggagaaagcuuaccauggacuggaccuggauccuguuccucguggccgccgcgacccgcguccacagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1980 - RNA, 964 nt, Artificial Sequence
  VP8* aa11-240 P[8] SP(IgE) w/o glyco mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1981 - RNA, 964 nt, Artificial Sequence
  VP8* aa11-240 P[8]-VirWa SP(IgE) w/o glyco mRNA opt Design1
gggagaaagcuuaccauggacuggaccuggauccuguuccucguggccgccgcgacccgcguccacagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1982 - RNA, 982 nt, Artificial Sequence
  VP8* aa11-240 P[4] SP(CD5) w/o glyco mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1983 - RNA, 982 nt, Artificial Sequence
  VP8* aa11-240 P[6] SP(CD5) w/o glyco mRNA opt Design1
gggagaaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1984 - RNA, 982 nt, Artificial Sequence
  VP8* aa11-240 P[8] SP(CD5) w/o glyco mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1985 - RNA, 982 nt, Artificial Sequence
  VP8* aa11-240 P[8]-VirWa SP(CD5) w/o glyco mRNA opt Design1
gggagaaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1986 - RNA, 982 nt, Artificial Sequence
  VP8* aa11-240 P[4] SP(HLA-A2) w/o glyco mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1987 - RNA, 982 nt, Artificial Sequence
  VP8* aa11-240 P[6] SP(HLA-A2) w/o glyco mRNA opt Design1
gggagaaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1988 - RNA, 982 nt, Artificial Sequence
  VP8* aa11-240 P[8] SP(HLA-A2) w/o glyco mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1989 - RNA, 982 nt, Artificial Sequence
  VP8* aa11-240 P[8]-VirWa SP(HLA-A2) w/o glyco mRNA opt Design1
gggagaaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1990 - RNA, 1033 nt, Artificial Sequence
  VP8* aa11-240 P[4] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1991 - RNA, 1033 nt, Artificial Sequence
  VP8* aa11-240 P[6] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1992 - RNA, 1033 nt, Artificial Sequence
  VP8* aa11-240 P[8] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1993 - RNA, 1033 nt, Artificial Sequence
  VP8* aa11-240 P[8]-VirWa SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1994 - RNA, 1024 nt, Artificial Sequence
  VP8* aa11-240 P[4] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1995 - RNA, 1024 nt, Artificial Sequence
  VP8* aa11-240 P[6] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1996 - RNA, 1024 nt, Artificial Sequence
  VP8* aa11-240 P[8] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1997 - RNA, 1024 nt, Artificial Sequence
  VP8* aa11-240 P[8]-VirWa SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1998 - RNA, 1024 nt, Artificial Sequence
  VP8* aa11-240 P[4] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1999 - RNA, 1024 nt, Artificial Sequence
  VP8* aa11-240 P[6] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2000 - RNA, 1024 nt, Artificial Sequence
  VP8* aa11-240 P[8] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2001 - RNA, 1024 nt, Artificial Sequence
  VP8* aa11-240 P[8]-VirWa SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2002 - RNA, 1042 nt, Artificial Sequence
  VP8* aa11-240 P[4] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2003 - RNA, 1042 nt, Artificial Sequence
  VP8* aa11-240 P[6] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2004 - RNA, 1042 nt, Artificial Sequence
  VP8* aa11-240 P[8] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2005 - RNA, 1042 nt, Artificial Sequence
  VP8* aa11-240 P[8]-VirWa SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2006 - RNA, 1042 nt, Artificial Sequence
  VP8* aa11-240 P[4] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2007 - RNA, 1042 nt, Artificial Sequence
  VP8* aa11-240 P[6] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2008 - RNA, 1042 nt, Artificial Sequence
  VP8* aa11-240 P[8] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2009 - RNA, 1042 nt, Artificial Sequence
  VP8* aa11-240 P[8]-VirWa SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2010 - RNA, 883 nt, Artificial Sequence
  VP8* aa21-240 P[4] mRNA opt Design1
gggagaaagcuuaccauggagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2011 - RNA, 883 nt, Artificial Sequence
  VP8* aa21-240 P[6] mRNA opt Design1
gggagaaagcuuaccauggagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2012 - RNA, 883 nt, Artificial Sequence
  VP8* aa21-240 P[8] mRNA opt Design1
gggagaaagcuuaccauggagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2013 - RNA, 883 nt, Artificial Sequence
  VP8* aa21-240 P[8]-VirWa mRNA opt Design1
gggagaaagcuuaccauggagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2014 - RNA, 943 nt, Artificial Sequence
  VP8* aa21-240 P[4] P2+Linker mRNA opt Design1
gggagaaagcuuaccaugcaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2015 - RNA, 943 nt, Artificial Sequence
  VP8* aa21-240 P[6] P2+Linker mRNA opt Design1
gggagaaagcuuaccaugcaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2016 - RNA, 943 nt, Artificial Sequence
  VP8* aa21-240 P[8] P2+Linker mRNA opt Design1
gggagaaagcuuaccaugcaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2017 - RNA, 943 nt, Artificial Sequence
  VP8* aa21-240 P[8]-VirWa P2+Linker mRNA opt Design1
gggagaaagcuuaccaugcaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2018 - RNA, 943 nt, Artificial Sequence
  VP8* aa21-240 P[4] SP(TPA) mRNA opt Design1
gggagaaagcuuaccauggacgccaugaagcgcggccugugcugcgugcuccugcugugcggggccgucuucgugagcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2019 - RNA, 943 nt, Artificial Sequence
  VP8* aa21-240 P[6] SP(TPA) mRNA opt Design1
gggagaaagcuuaccauggacgccaugaagcgcggccugugcugcgugcuccugcugugcggggccgucuucgugagcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2020 - RNA, 943 nt, Artificial Sequence
  VP8* aa21-240 P[8] SP(TPA) mRNA opt Design1
gggagaaagcuuaccauggacgccaugaagcgcggccugugcugcgugcuccugcugugcggggccgucuucgugagcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2021 - RNA, 943 nt, Artificial Sequence
  VP8* aa21-240 P[8]-VirWa SP(TPA) mRNA opt Design1
gggagaaagcuuaccauggacgccaugaagcgcggccugugcugcgugcuccugcugugcggggccgucuucgugagcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2022 - RNA, 934 nt, Artificial Sequence
  VP8* aa21-240 P[4] SP(HSA) mRNA opt Design1
gggagaaagcuuaccaugaagugggugaccuucaucagccugcucuuccuguucuccagcgccuacuccgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2023 - RNA, 934 nt, Artificial Sequence
  VP8* aa21-240 P[6] SP(HSA) mRNA opt Design1
gggagaaagcuuaccaugaagugggugaccuucaucagccugcucuuccuguucuccagcgccuacuccgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2024 - RNA, 934 nt, Artificial Sequence
  VP8* aa21-240 P[8] SP(HSA) mRNA opt Design1
gggagaaagcuuaccaugaagugggugaccuucaucagccugcucuuccuguucuccagcgccuacuccgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2025 - RNA, 934 nt, Artificial Sequence
  VP8* aa21-240 P[8]-VirWa SP(HSA) mRNA opt Design1
gggagaaagcuuaccaugaagugggugaccuucaucagccugcucuuccuguucuccagcgccuacuccgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2026 - RNA, 934 nt, Artificial Sequence
  VP8* aa21-240 P[4] SP(IgE) mRNA opt Design1
gggagaaagcuuaccauggacuggaccuggauccuguuccucguggccgccgcgacccgcguccacagcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2027 - RNA, 934 nt, Artificial Sequence
  VP8* aa21-240 P[6] SP(IgE) mRNA opt Design1
gggagaaagcuuaccauggacuggaccuggauccuguuccucguggccgccgcgacccgcguccacagcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2028 - RNA, 934 nt, Artificial Sequence
  VP8* aa21-240 P[8] SP(IgE) mRNA opt Design1
gggagaaagcuuaccauggacuggaccuggauccuguuccucguggccgccgcgacccgcguccacagcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2029 - RNA, 934 nt, Artificial Sequence
  VP8* aa21-240 P[8]-VirWa SP(IgE) mRNA opt Design1
gggagaaagcuuaccauggacuggaccuggauccuguuccucguggccgccgcgacccgcguccacagcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2030 - RNA, 952 nt, Artificial Sequence
  VP8* aa21-240 P[4] SP(CD5) mRNA opt Design1
gggagaaagcuuaccaugcccaugggcagccugcagccgcucgccacccuguaccugcucgggaugcugguggccuccugccugggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2031 - RNA, 952 nt, Artificial Sequence
  VP8* aa21-240 P[6] SP(CD5) mRNA opt Design1
gggagaaagcuuaccaugcccaugggcagccugcagccgcucgccacccuguaccugcucgggaugcugguggccuccugccugggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2032 - RNA, 952 nt, Artificial Sequence
  VP8* aa21-240 P[8] SP(CD5) mRNA opt Design1
gggagaaagcuuaccaugcccaugggcagccugcagccgcucgccacccuguaccugcucgggaugcugguggccuccugccugggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2033 - RNA, 952 nt, Artificial Sequence
  VP8* aa21-240 P[8]-VirWa SP(CD5) mRNA opt Design1
gggagaaagcuuaccaugcccaugggcagccugcagccgcucgccacccuguaccugcucgggaugcugguggccuccugccugggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2034 - RNA, 952 nt, Artificial Sequence
  VP8* aa21-240 P[4] SP(HLA-A2) mRNA opt Design1
gggagaaagcuuaccauggccgugauggccccgcggacccugguccuccugcugagcggcgcgcucgcccugacccagacgugggccgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2035 - RNA, 952 nt, Artificial Sequence
  VP8* aa21-240 P[6] SP(HLA-A2) mRNA opt Design1
gggagaaagcuuaccauggccgugauggccccgcggacccugguccuccugcugagcggcgcgcucgcccugacccagacgugggccgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2036 - RNA, 952 nt, Artificial Sequence
  VP8* aa21-240 P[8] SP(HLA-A2) mRNA opt Design1
gggagaaagcuuaccauggccgugauggccccgcggacccugguccuccugcugagcggcgcgcucgcccugacccagacgugggccgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2037 - RNA, 952 nt, Artificial Sequence
  VP8* aa21-240 P[8]-VirWa SP(HLA-A2) mRNA opt Design1
gggagaaagcuuaccauggccgugauggccccgcggacccugguccuccugcugagcggcgcgcucgcccugacccagacgugggccgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2038 - RNA, 1003 nt, Artificial Sequence
  VP8* aa21-240 P[4] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2039 - RNA, 1003 nt, Artificial Sequence
  VP8* aa21-240 P[6] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2040 - RNA, 1003 nt, Artificial Sequence
  VP8* aa21-240 P[8] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2041 - RNA, 1003 nt, Artificial Sequence
  VP8* aa21-240 P[8]-VirWa SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2042 - RNA, 994 nt, Artificial Sequence
  VP8* aa21-240 P[4] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2043 - RNA, 994 nt, Artificial Sequence
  VP8* aa21-240 P[6] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2044 - RNA, 994 nt, Artificial Sequence
  VP8* aa21-240 P[8] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2045 - RNA, 994 nt, Artificial Sequence
  VP8* aa21-240 P[8]-VirWa SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2046 - RNA, 994 nt, Artificial Sequence
  VP8* aa21-240 P[4] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2047 - RNA, 994 nt, Artificial Sequence
  VP8* aa21-240 P[6] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2048 - RNA, 994 nt, Artificial Sequence
  VP8* aa21-240 P[8] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2049 - RNA, 994 nt, Artificial Sequence
  VP8* aa21-240 P[8]-VirWa SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2050 - RNA, 1012 nt, Artificial Sequence
  VP8* aa21-240 P[4] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2051 - RNA, 1012 nt, Artificial Sequence
  VP8* aa21-240 P[6] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2052 - RNA, 1012 nt, Artificial Sequence
  VP8* aa21-240 P[8] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2053 - RNA, 1012 nt, Artificial Sequence
  VP8* aa21-240 P[8]-VirWa SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2054 - RNA, 1012 nt, Artificial Sequence
  VP8* aa21-240 P[4] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2055 - RNA, 1012 nt, Artificial Sequence
  VP8* aa21-240 P[6] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2056 - RNA, 1012 nt, Artificial Sequence
  VP8* aa21-240 P[8] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2057 - RNA, 1012 nt, Artificial Sequence
  VP8* aa21-240 P[8]-VirWa SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2058 - RNA, 883 nt, Artificial Sequence
  VP8* aa21-240 P[4] w/o glyco mRNA opt Design1
gggagaaagcuuaccauggagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2059 - RNA, 883 nt, Artificial Sequence
  VP8* aa21-240 P[6] w/o glyco mRNA opt Design1
gggagaaagcuuaccauggagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2060 - RNA, 883 nt, Artificial Sequence
  VP8* aa21-240 P[8] w/o glyco mRNA opt Design1
gggagaaagcuuaccauggagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2061 - RNA, 883 nt, Artificial Sequence
  VP8* aa21-240 P[8]-VirWa w/o glyco mRNA opt Design1
gggagaaagcuuaccauggagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2062 - RNA, 943 nt, Artificial Sequence
  VP8* aa21-240 P[4] P2+Linker w/o glyco mRNA opt Design1
gggagaaagcuuaccaugcaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2063 - RNA, 943 nt, Artificial Sequence
  VP8* aa21-240 P[6] P2+Linker w/o glyco mRNA opt Design1
gggagaaagcuuaccaugcaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2064 - RNA, 943 nt, Artificial Sequence
  VP8* aa21-240 P[8] P2+Linker w/o glyco mRNA opt Design1
gggagaaagcuuaccaugcaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2065 - RNA, 943 nt, Artificial Sequence
  VP8* aa21-240 P[8]-VirWa P2+Linker w/o glyco mRNA opt Design1
gggagaaagcuuaccaugcaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2066 - RNA, 943 nt, Artificial Sequence
  VP8* aa21-240 P[4] SP(TPA) w/o glyco mRNA opt Design1
gggagaaagcuuaccauggacgccaugaagcgcggccugugcugcgugcuccugcugugcggggccgucuucgugagcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2067 - RNA, 943 nt, Artificial Sequence
  VP8* aa21-240 P[6] SP(TPA) w/o glyco mRNA opt Design1
gggagaaagcuuaccauggacgccaugaagcgcggccugugcugcgugcuccugcugugcggggccgucuucgugagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2068 - RNA, 943 nt, Artificial Sequence
  VP8* aa21-240 P[8] SP(TPA) w/o glyco mRNA opt Design1
gggagaaagcuuaccauggacgccaugaagcgcggccugugcugcgugcuccugcugugcggggccgucuucgugagcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2069 - RNA, 943 nt, Artificial Sequence
  VP8* aa21-240 P[8]-VirWa SP(TPA) w/o glyco mRNA opt Design1
gggagaaagcuuaccauggacgccaugaagcgcggccugugcugcgugcuccugcugugcggggccgucuucgugagcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2070 - RNA, 934 nt, Artificial Sequence
  VP8* aa21-240 P[4] SP(HSA) w/o glyco mRNA opt Design1
gggagaaagcuuaccaugaagugggugaccuucaucagccugcucuuccuguucuccagcgccuacuccgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2071 - RNA, 934 nt, Artificial Sequence
  VP8* aa21-240 P[6] SP(HSA) w/o glyco mRNA opt Design1
gggagaaagcuuaccaugaagugggugaccuucaucagccugcucuuccuguucuccagcgccuacuccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2072 - RNA, 934 nt, Artificial Sequence
  VP8* aa21-240 P[8] SP(HSA) w/o glyco mRNA opt Design1
gggagaaagcuuaccaugaagugggugaccuucaucagccugcucuuccuguucuccagcgccuacuccgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2073 - RNA, 934 nt, Artificial Sequence
  VP8* aa21-240 P[8]-VirWa SP(HSA) w/o glyco mRNA opt Design1
gggagaaagcuuaccaugaagugggugaccuucaucagccugcucuuccuguucuccagcgccuacuccgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2074 - RNA, 934 nt, Artificial Sequence
  VP8* aa21-240 P[4] SP(IgE) w/o glyco mRNA opt Design1
gggagaaagcuuaccauggacuggaccuggauccuguuccucguggccgccgcgacccgcguccacagcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2075 - RNA, 934 nt, Artificial Sequence
  VP8* aa21-240 P[6] SP(IgE) w/o glyco mRNA opt Design1
gggagaaagcuuaccauggacuggaccuggauccuguuccucguggccgccgcgacccgcguccacagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2076 - RNA, 934 nt, Artificial Sequence
  VP8* aa21-240 P[8] SP(IgE) w/o glyco mRNA opt Design1
gggagaaagcuuaccauggacuggaccuggauccuguuccucguggccgccgcgacccgcguccacagcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2077 - RNA, 934 nt, Artificial Sequence
  VP8* aa21-240 P[8]-VirWa SP(IgE) w/o glyco mRNA opt Design1
gggagaaagcuuaccauggacuggaccuggauccuguuccucguggccgccgcgacccgcguccacagcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2078 - RNA, 952 nt, Artificial Sequence
  VP8* aa21-240 P[4] SP(CD5) w/o glyco mRNA opt Design1
gggagaaagcuuaccaugcccaugggcagccugcagccgcucgccacccuguaccugcucgggaugcugguggccuccugccugggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2079 - RNA, 952 nt, Artificial Sequence
  VP8* aa21-240 P[6] SP(CD5) w/o glyco mRNA opt Design1
gggagaaagcuuaccaugcccaugggcagccugcagccgcucgccacccuguaccugcucgggaugcugguggccuccugccugggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2080 - RNA, 952 nt, Artificial Sequence
  VP8* aa21-240 P[8] SP(CD5) w/o glyco mRNA opt Design1
gggagaaagcuuaccaugcccaugggcagccugcagccgcucgccacccuguaccugcucgggaugcugguggccuccugccugggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2081 - RNA, 952 nt, Artificial Sequence
  VP8* aa21-240 P[8]-VirWa SP(CD5) w/o glyco mRNA opt Design1
gggagaaagcuuaccaugcccaugggcagccugcagccgcucgccacccuguaccugcucgggaugcugguggccuccugccugggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2082 - RNA, 952 nt, Artificial Sequence
  VP8* aa21-240 P[4] SP(HLA-A2) w/o glyco mRNA opt Design1
gggagaaagcuuaccauggccgugauggccccgcggacccugguccuccugcugagcggcgcgcucgcccugacccagacgugggccgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2083 - RNA, 952 nt, Artificial Sequence
  VP8* aa21-240 P[6] SP(HLA-A2) w/o glyco mRNA opt Design1
gggagaaagcuuaccauggccgugauggccccgcggacccugguccuccugcugagcggcgcgcucgcccugacccagacgugggccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2084 - RNA, 952 nt, Artificial Sequence
  VP8* aa21-240 P[8] SP(HLA-A2) w/o glyco mRNA opt Design1
gggagaaagcuuaccauggccgugauggccccgcggacccugguccuccugcugagcggcgcgcucgcccugacccagacgugggccgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2085 - RNA, 952 nt, Artificial Sequence
  VP8* aa21-240 P[8]-VirWa SP(HLA-A2) w/o glyco mRNA opt Design1
gggagaaagcuuaccauggccgugauggccccgcggacccugguccuccugcugagcggcgcgcucgcccugacccagacgugggccgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2086 - RNA, 1003 nt, Artificial Sequence
  VP8* aa21-240 P[4] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2087 - RNA, 1003 nt, Artificial Sequence
  VP8* aa21-240 P[6] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2088 - RNA, 1003 nt, Artificial Sequence
  VP8* aa21-240 P[8] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2089 - RNA, 1003 nt, Artificial Sequence
  VP8* aa21-240 P[8]-VirWa SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2090 - RNA, 994 nt, Artificial Sequence
  VP8* aa21-240 P[4] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2091 - RNA, 994 nt, Artificial Sequence
  VP8* aa21-240 P[6] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2092 - RNA, 994 nt, Artificial Sequence
  VP8* aa21-240 P[8] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2093 - RNA, 994 nt, Artificial Sequence
  VP8* aa21-240 P[8]-VirWa SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2094 - RNA, 994 nt, Artificial Sequence
  VP8* aa21-240 P[4] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2095 - RNA, 994 nt, Artificial Sequence
  VP8* aa21-240 P[6] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2096 - RNA, 994 nt, Artificial Sequence
  VP8* aa21-240 P[8] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2097 - RNA, 994 nt, Artificial Sequence
  VP8* aa21-240 P[8]-VirWa SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2098 - RNA, 1012 nt, Artificial Sequence
  VP8* aa21-240 P[4] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2099 - RNA, 1012 nt, Artificial Sequence
  VP8* aa21-240 P[6] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2100 - RNA, 1012 nt, Artificial Sequence
  VP8* aa21-240 P[8] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2101 - RNA, 1012 nt, Artificial Sequence
  VP8* aa21-240 P[8]-VirWa SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2102 - RNA, 1012 nt, Artificial Sequence
  VP8* aa21-240 P[4] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2103 - RNA, 1012 nt, Artificial Sequence
  VP8* aa21-240 P[6] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2104 - RNA, 1012 nt, Artificial Sequence
  VP8* aa21-240 P[8] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2105 - RNA, 1012 nt, Artificial Sequence
  VP8* aa21-240 P[8]-VirWa SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2106 - RNA, 772 nt, Artificial Sequence
  VP8* aa41-223P[4] mRNA opt Design1
gggagaaagcuuaccauggcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2107 - RNA, 772 nt, Artificial Sequence
  VP8* aa41-223P[6] mRNA opt Design1
gggagaaagcuuaccauggcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2108 - RNA, 772 nt, Artificial Sequence
  VP8* aa41-223P[8] mRNA opt Design1
gggagaaagcuuaccauggcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2109 - RNA, 772 nt, Artificial Sequence
  VP8* aa41-223P[8]-VirWa mRNA opt Design1
gggagaaagcuuaccauggcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2110 - RNA, 832 nt, Artificial Sequence
  VP8* aa41-223P[4] P2+Linker mRNA opt Design1
gggagaaagcuuaccaugcaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2111 - RNA, 832 nt, Artificial Sequence
  VP8* aa41-223P[6] P2+Linker mRNA opt Design1
gggagaaagcuuaccaugcaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2112 - RNA, 832 nt, Artificial Sequence
  VP8* aa41-223P[8] P2+Linker mRNA opt Design1
gggagaaagcuuaccaugcaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2113 - RNA, 832 nt, Artificial Sequence
  VP8* aa41-223P[8]-VirWa P2+Linker mRNA opt Design1
gggagaaagcuuaccaugcaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2114 - RNA, 832 nt, Artificial Sequence
  VP8* aa41-223P[4] SP(TPA) mRNA opt Design1
gggagaaagcuuaccauggacgccaugaagcgcggccugugcugcgugcuccugcugugcggggccgucuucgugagcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2115 - RNA, 832 nt, Artificial Sequence
  VP8* aa41-223P[6] SP(TPA) mRNA opt Design1
gggagaaagcuuaccauggacgccaugaagcgcggccugugcugcgugcuccugcugugcggggccgucuucgugagcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2116 - RNA, 832 nt, Artificial Sequence
  VP8* aa41-223P[8] SP(TPA) mRNA opt Design1
gggagaaagcuuaccauggacgccaugaagcgcggccugugcugcgugcuccugcugugcggggccgucuucgugagcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2117 - RNA, 832 nt, Artificial Sequence
  VP8* aa41-223P[8]-VirWa SP(TPA) mRNA opt Design1
gggagaaagcuuaccauggacgccaugaagcgcggccugugcugcgugcuccugcugugcggggccgucuucgugagcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2118 - RNA, 823 nt, Artificial Sequence
  VP8* aa41-223P[4] SP(HSA) mRNA opt Design1
gggagaaagcuuaccaugaagugggugaccuucaucagccugcucuuccuguucuccagcgccuacuccgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2119 - RNA, 823 nt, Artificial Sequence
  VP8* aa41-223P[6] SP(HSA) mRNA opt Design1
gggagaaagcuuaccaugaagugggugaccuucaucagccugcucuuccuguucuccagcgccuacuccgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2120 - RNA, 823 nt, Artificial Sequence
  VP8* aa41-223P[8] SP(HSA) mRNA opt Design1
gggagaaagcuuaccaugaagugggugaccuucaucagccugcucuuccuguucuccagcgccuacuccgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2121 - RNA, 823 nt, Artificial Sequence
  VP8* aa41-223P[8]-VirWa SP(HSA) mRNA opt Design1
gggagaaagcuuaccaugaagugggugaccuucaucagccugcucuuccuguucuccagcgccuacuccgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2122 - RNA, 823 nt, Artificial Sequence
  VP8* aa41-223P[4] SP(IgE) mRNA opt Design1
gggagaaagcuuaccauggacuggaccuggauccuguuccucguggccgccgcgacccgcguccacagcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2123 - RNA, 823 nt, Artificial Sequence
  VP8* aa41-223P[6] SP(IgE) mRNA opt Design1
gggagaaagcuuaccauggacuggaccuggauccuguuccucguggccgccgcgacccgcguccacagcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2124 - RNA, 823 nt, Artificial Sequence
  VP8* aa41-223P[8] SP(IgE) mRNA opt Design1
gggagaaagcuuaccauggacuggaccuggauccuguuccucguggccgccgcgacccgcguccacagcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2125 - RNA, 823 nt, Artificial Sequence
  VP8* aa41-223P[8]-VirWa SP(IgE) mRNA opt Design1
gggagaaagcuuaccauggacuggaccuggauccuguuccucguggccgccgcgacccgcguccacagcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2126 - RNA, 841 nt, Artificial Sequence
  VP8* aa41-223P[4] SP(CD5) mRNA opt Design1
gggagaaagcuuaccaugcccaugggcagccugcagccgcucgccacccuguaccugcucgggaugcugguggccuccugccugggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2127 - RNA, 841 nt, Artificial Sequence
  VP8* aa41-223P[6] SP(CD5) mRNA opt Design1
gggagaaagcuuaccaugcccaugggcagccugcagccgcucgccacccuguaccugcucgggaugcugguggccuccugccugggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2128 - RNA, 841 nt, Artificial Sequence
  VP8* aa41-223P[8] SP(CD5) mRNA opt Design1
gggagaaagcuuaccaugcccaugggcagccugcagccgcucgccacccuguaccugcucgggaugcugguggccuccugccugggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2129 - RNA, 841 nt, Artificial Sequence
  VP8* aa41-223P[8]-VirWa SP(CD5) mRNA opt Design1
gggagaaagcuuaccaugcccaugggcagccugcagccgcucgccacccuguaccugcucgggaugcugguggccuccugccugggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2130 - RNA, 841 nt, Artificial Sequence
  VP8* aa41-223P[4] SP(HLA-A2) mRNA opt Design1
gggagaaagcuuaccauggccgugauggccccgcggacccugguccuccugcugagcggcgcgcucgcccugacccagacgugggccgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2131 - RNA, 841 nt, Artificial Sequence
  VP8* aa41-223P[6] SP(HLA-A2) mRNA opt Design1
gggagaaagcuuaccauggccgugauggccccgcggacccugguccuccugcugagcggcgcgcucgcccugacccagacgugggccgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2132 - RNA, 841 nt, Artificial Sequence
  VP8* aa41-223P[8] SP(HLA-A2) mRNA opt Design1
gggagaaagcuuaccauggccgugauggccccgcggacccugguccuccugcugagcggcgcgcucgcccugacccagacgugggccgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2133 - RNA, 841 nt, Artificial Sequence
  VP8* aa41-223P[8]-VirWa SP(HLA-A2) mRNA opt Design1
gggagaaagcuuaccauggccgugauggccccgcggacccugguccuccugcugagcggcgcgcucgcccugacccagacgugggccgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2134 - RNA, 892 nt, Artificial Sequence
  VP8* aa41-223P[4] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2135 - RNA, 892 nt, Artificial Sequence
  VP8* aa41-223P[6] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2136 - RNA, 892 nt, Artificial Sequence
  VP8* aa41-223P[8] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2137 - RNA, 892 nt, Artificial Sequence
  VP8* aa41-223P[8]-VirWa SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2138 - RNA, 883 nt, Artificial Sequence
  VP8* aa41-223P[4] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2139 - RNA, 883 nt, Artificial Sequence
  VP8* aa41-223P[6] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2140 - RNA, 883 nt, Artificial Sequence
  VP8* aa41-223P[8] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2141 - RNA, 883 nt, Artificial Sequence
  VP8* aa41-223P[8]-VirWa SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2142 - RNA, 883 nt, Artificial Sequence
  VP8* aa41-223P[4] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2143 - RNA, 883 nt, Artificial Sequence
  VP8* aa41-223P[6] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2144 - RNA, 883 nt, Artificial Sequence
  VP8* aa41-223P[8] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2145 - RNA, 883 nt, Artificial Sequence
  VP8* aa41-223P[8]-VirWa SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2146 - RNA, 901 nt, Artificial Sequence
  VP8* aa41-223P[4] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2147 - RNA, 901 nt, Artificial Sequence
  VP8* aa41-223P[6] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2148 - RNA, 901 nt, Artificial Sequence
  VP8* aa41-223P[8] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2149 - RNA, 901 nt, Artificial Sequence
  VP8* aa41-223P[8]-VirWa SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2150 - RNA, 901 nt, Artificial Sequence
  VP8* aa41-223P[4] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2151 - RNA, 901 nt, Artificial Sequence
  VP8* aa41-223P[6] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2152 - RNA, 901 nt, Artificial Sequence
  VP8* aa41-223P[8] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2153 - RNA, 901 nt, Artificial Sequence
  VP8* aa41-223P[8]-VirWa SP(HLA-A2)+P2Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2154 - RNA, 772 nt, Artificial Sequence
  VP8* aa41-223P[4] w/o glyco mRNA opt Design1
gggagaaagcuuaccauggcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2155 - RNA, 772 nt, Artificial Sequence
  VP8* aa41-223P[6] w/o glyco mRNA opt Design1
gggagaaagcuuaccauggcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2156 - RNA, 772 nt, Artificial Sequence
  VP8* aa41-223P[8] w/o glyco mRNA opt Design1
gggagaaagcuuaccauggcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2157 - RNA, 772 nt, Artificial Sequence
  VP8* aa41-223P[8]-VirWa w/o glyco mRNA opt Design1
gggagaaagcuuaccauggcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2158 - RNA, 832 nt, Artificial Sequence
  VP8* aa41-223P[4] P2+Linker w/o glyco mRNA opt Design1
gggagaaagcuuaccaugcaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2159 - RNA, 832 nt, Artificial Sequence
  VP8* aa41-223P[6] P2+Linker w/o glyco mRNA opt Design1
gggagaaagcuuaccaugcaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2160 - RNA, 832 nt, Artificial Sequence
  VP8* aa41-223P[8] P2+Linker w/o glyco mRNA opt Design1
gggagaaagcuuaccaugcaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2161 - RNA, 832 nt, Artificial Sequence
  VP8* aa41-223P[8]-VirWa P2+Linker w/o glyco mRNA opt Design1
gggagaaagcuuaccaugcaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2162 - RNA, 832 nt, Artificial Sequence
  VP8* aa41-223P[4] SP(TPA) w/o glyco mRNA opt Design1
gggagaaagcuuaccauggacgccaugaagcgcggccugugcugcgugcuccugcugugcggggccgucuucgugagcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2163 - RNA, 832 nt, Artificial Sequence
  VP8* aa41-223P[6] SP(TPA) w/o glyco mRNA opt Design1
gggagaaagcuuaccauggacgccaugaagcgcggccugugcugcgugcuccugcugugcggggccgucuucgugagcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2164 - RNA, 832 nt, Artificial Sequence
  VP8* aa41-223P[8] SP(TPA) w/o glyco mRNA opt Design1
gggagaaagcuuaccauggacgccaugaagcgcggccugugcugcgugcuccugcugugcggggccgucuucgugagcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2165 - RNA, 832 nt, Artificial Sequence
  VP8* aa41-223P[8]-VirWa SP(TPA) w/o glyco mRNA opt Design1
gggagaaagcuuaccauggacgccaugaagcgcggccugugcugcgugcuccugcugugcggggccgucuucgugagcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2166 - RNA, 823 nt, Artificial Sequence
  VP8* aa41-223P[4] SP(HSA) w/o glyco mRNA opt Design1
gggagaaagcuuaccaugaagugggugaccuucaucagccugcucuuccuguucuccagcgccuacuccgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2167 - RNA, 823 nt, Artificial Sequence
  VP8* aa41-223P[6] SP(HSA) w/o glyco mRNA opt Design1
gggagaaagcuuaccaugaagugggugaccuucaucagccugcucuuccuguucuccagcgccuacuccgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2168 - RNA, 823 nt, Artificial Sequence
  VP8* aa41-223P[8] SP(HSA) w/o glyco mRNA opt Design1
gggagaaagcuuaccaugaagugggugaccuucaucagccugcucuuccuguucuccagcgccuacuccgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2169 - RNA, 823 nt, Artificial Sequence
  VP8* aa41-223P[8]-VirWa SP(HSA) w/o glyco mRNA opt Design1
gggagaaagcuuaccaugaagugggugaccuucaucagccugcucuuccuguucuccagcgccuacuccgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2170 - RNA, 823 nt, Artificial Sequence
  VP8* aa41-223P[4] SP(IgE) w/o glyco mRNA opt Design1
gggagaaagcuuaccauggacuggaccuggauccuguuccucguggccgccgcgacccgcguccacagcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2171 - RNA, 823 nt, Artificial Sequence
  VP8* aa41-223P[6] SP(IgE) w/o glyco mRNA opt Design1
gggagaaagcuuaccauggacuggaccuggauccuguuccucguggccgccgcgacccgcguccacagcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2172 - RNA, 823 nt, Artificial Sequence
  VP8* aa41-223P[8] SP(IgE) w/o glyco mRNA opt Design1
gggagaaagcuuaccauggacuggaccuggauccuguuccucguggccgccgcgacccgcguccacagcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2173 - RNA, 823 nt, Artificial Sequence
  VP8* aa41-223P[8]-VirWa SP(IgE) w/o glyco mRNA opt Design1
gggagaaagcuuaccauggacuggaccuggauccuguuccucguggccgccgcgacccgcguccacagcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2174 - RNA, 841 nt, Artificial Sequence
  VP8* aa41-223P[4] SP(CD5) w/o glyco mRNA opt Design1
gggagaaagcuuaccaugcccaugggcagccugcagccgcucgccacccuguaccugcucgggaugcugguggccuccugccugggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2175 - RNA, 841 nt, Artificial Sequence
  VP8* aa41-223P[6] SP(CD5) w/o glyco mRNA opt Design1
gggagaaagcuuaccaugcccaugggcagccugcagccgcucgccacccuguaccugcucgggaugcugguggccuccugccugggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2176 - RNA, 841 nt, Artificial Sequence
  VP8* aa41-223P[8] SP(CD5) w/o glyco mRNA opt Design1
gggagaaagcuuaccaugcccaugggcagccugcagccgcucgccacccuguaccugcucgggaugcugguggccuccugccugggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2177 - RNA, 841 nt, Artificial Sequence
  VP8* aa41-223P[8]-VirWa SP(CD5) w/o glyco mRNA opt Design1
gggagaaagcuuaccaugcccaugggcagccugcagccgcucgccacccuguaccugcucgggaugcugguggccuccugccugggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2178 - RNA, 841 nt, Artificial Sequence
  VP8* aa41-223P[4] SP(HLA-A2) w/o glyco mRNA opt Design1
gggagaaagcuuaccauggccgugauggccccgcggacccugguccuccugcugagcggcgcgcucgcccugacccagacgugggccgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2179 - RNA, 841 nt, Artificial Sequence
  VP8* aa41-223P[6] SP(HLA-A2) w/o glyco mRNA opt Design1
gggagaaagcuuaccauggccgugauggccccgcggacccugguccuccugcugagcggcgcgcucgcccugacccagacgugggccgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2180 - RNA, 841 nt, Artificial Sequence
  VP8* aa41-223P[8] SP(HLA-A2) w/o glyco mRNA opt Design1
gggagaaagcuuaccauggccgugauggccccgcggacccugguccuccugcugagcggcgcgcucgcccugacccagacgugggccgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2181 - RNA, 841 nt, Artificial Sequence
  VP8* aa41-223P[8]-VirWa SP(HLA-A2) w/o glyco mRNA opt Design1
gggagaaagcuuaccauggccgugauggccccgcggacccugguccuccugcugagcggcgcgcucgcccugacccagacgugggccgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2182 - RNA, 892 nt, Artificial Sequence
  VP8* aa41-223P[4] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2183 - RNA, 892 nt, Artificial Sequence
  VP8* aa41-223P[6] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2184 - RNA, 892 nt, Artificial Sequence
  VP8* aa41-223P[8] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2185 - RNA, 892 nt, Artificial Sequence
  VP8* aa41-223P[8]-VirWa SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2186 - RNA, 883 nt, Artificial Sequence
  VP8* aa41-223P[4] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2187 - RNA, 883 nt, Artificial Sequence
  VP8* aa41-223P[6] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2188 - RNA, 883 nt, Artificial Sequence
  VP8* aa41-223P[8] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2189 - RNA, 883 nt, Artificial Sequence
  VP8* aa41-223P[8]-VirWa SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2190 - RNA, 883 nt, Artificial Sequence
  VP8* aa41-223P[4] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2191 - RNA, 883 nt, Artificial Sequence
  VP8* aa41-223P[6] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2192 - RNA, 883 nt, Artificial Sequence
  VP8* aa41-223P[8] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2193 - RNA, 883 nt, Artificial Sequence
  VP8* aa41-223P[8]-VirWa SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2194 - RNA, 901 nt, Artificial Sequence
  VP8* aa41-223P[4] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2195 - RNA, 901 nt, Artificial Sequence
  VP8* aa41-223P[6] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2196 - RNA, 901 nt, Artificial Sequence
  VP8* aa41-223P[8] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2197 - RNA, 901 nt, Artificial Sequence
  VP8* aa41-223 P[8]-VirWa SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2198 - RNA, 901 nt, Artificial Sequence
  VP8* aa41-223P[4] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2199 - RNA, 901 nt, Artificial Sequence
  VP8* aa41-223 P[6] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2200 - RNA, 901 nt, Artificial Sequence
  VP8* aa41-223 P[8] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2201 - RNA, 901 nt, Artificial Sequence
  VP8* aa41-223P[8]-VirWa SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2202 - RNA, 700 nt, Artificial Sequence
  VP8* aa65-223short P[4] mRNA opt Design1
gggagaaagcuuaccaugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2203 - RNA, 700 nt, Artificial Sequence
  VP8* aa65-223short P[6] mRNA opt Design1
gggagaaagcuuaccaugcucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2204 - RNA, 700 nt, Artificial Sequence
  VP8* aa65-223 short P[8] mRNA opt Design1
gggagaaagcuuaccaugcucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2205 - RNA, 700 nt, Artificial Sequence
  VP8* aa65-223short P[8]-VirWa mRNA opt Design1
gggagaaagcuuaccaugcucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2206 - RNA, 760 nt, Artificial Sequence
  VP8* aa65-223short P[4] P2+Linker mRNA opt Design1
gggagaaagcuuaccaugcaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2207 - RNA, 760 nt, Artificial Sequence
  VP8* aa65-223short P[6] P2+Linker mRNA opt Design1
gggagaaagcuuaccaugcaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2208 - RNA, 760 nt, Artificial Sequence
  VP8* aa65-223 short P[8] P2+Linker mRNA opt Design1
gggagaaagcuuaccaugcaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2209 - RNA, 760 nt, Artificial Sequence
  VP8* aa65-223short P[8]-VirWa P2+Linker mRNA opt Design1
gggagaaagcuuaccaugcaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2210 - RNA, 760 nt, Artificial Sequence
  VP8* aa65-223short P[4] SP(TPA) mRNA opt Design1
gggagaaagcuuaccauggacgccaugaagcgcggccugugcugcgugcuccugcugugcggggccgucuucgugagccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2211 - RNA, 760 nt, Artificial Sequence
  VP8* aa65-223short P[6] SP(TPA) mRNA opt Design1
gggagaaagcuuaccauggacgccaugaagcgcggccugugcugcgugcuccugcugugcggggccgucuucgugagccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2212 - RNA, 760 nt, Artificial Sequence
  VP8* aa65-223 short P[8] SP(TPA) mRNA opt Design1
gggagaaagcuuaccauggacgccaugaagcgcggccugugcugcgugcuccugcugugcggggccgucuucgugagccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2213 - RNA, 760 nt, Artificial Sequence
  VP8* aa65-223short P[8]-VirWa SP(TPA) mRNA opt Design1
gggagaaagcuuaccauggacgccaugaagcgcggccugugcugcgugcuccugcugugcggggccgucuucgugagccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2214 - RNA, 751 nt, Artificial Sequence
  VP8* aa65-223short P[4] SP(HSA) mRNA opt Design1
gggagaaagcuuaccaugaagugggugaccuucaucagccugcucuuccuguucuccagcgccuacucccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2215 - RNA, 751 nt, Artificial Sequence
  VP8* aa65-223short P[6] SP(HSA) mRNA opt Design1
gggagaaagcuuaccaugaagugggugaccuucaucagccugcucuuccuguucuccagcgccuacucccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2216 - RNA, 751 nt, Artificial Sequence
  VP8* aa65-223 short P[8] SP(HSA) mRNA opt Design1
gggagaaagcuuaccaugaagugggugaccuucaucagccugcucuuccuguucuccagcgccuacucccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2217 - RNA, 751 nt, Artificial Sequence
  VP8* aa65-223short P[8]-VirWa SP(HSA) mRNA opt Design1
gggagaaagcuuaccaugaagugggugaccuucaucagccugcucuuccuguucuccagcgccuacucccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2218 - RNA, 751 nt, Artificial Sequence
  VP8* aa65-223short P[4] SP(IgE) mRNA opt Design1
gggagaaagcuuaccauggacuggaccuggauccuguuccucguggccgccgcgacccgcguccacagccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2219 - RNA, 751 nt, Artificial Sequence
  VP8* aa65-223short P[6]SP(IgE) mRNA opt Design1
gggagaaagcuuaccauggacuggaccuggauccuguuccucguggccgccgcgacccgcguccacagccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2220 - RNA, 751 nt, Artificial Sequence
  VP8* aa65-223 short P[8] SP(IgE) mRNA opt Design1
gggagaaagcuuaccauggacuggaccuggauccuguuccucguggccgccgcgacccgcguccacagccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2221 - RNA, 751 nt, Artificial Sequence
  VP8* aa65-223short P[8]-VirWa SP(IgE) mRNA opt Design1
gggagaaagcuuaccauggacuggaccuggauccuguuccucguggccgccgcgacccgcguccacagccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2222 - RNA, 769 nt, Artificial Sequence
  VP8* aa65-223short P[4] SP(CD5) mRNA opt Design1
gggagaaagcuuaccaugcccaugggcagccugcagccgcucgccacccuguaccugcucgggaugcugguggccuccugccugggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2223 - RNA, 769 nt, Artificial Sequence
  VP8* aa65-223short P[6] SP(CD5) mRNA opt Design1
gggagaaagcuuaccaugcccaugggcagccugcagccgcucgccacccuguaccugcucgggaugcugguggccuccugccugggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2224 - RNA, 769 nt, Artificial Sequence
  VP8* aa65-223 short P[8] SP(CD5) mRNA opt Design1
gggagaaagcuuaccaugcccaugggcagccugcagccgcucgccacccuguaccugcucgggaugcugguggccuccugccugggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2225 - RNA, 769 nt, Artificial Sequence
  VP8* aa65-223short P[8]-VirWa SP(CD5) mRNA opt Design1
gggagaaagcuuaccaugcccaugggcagccugcagccgcucgccacccuguaccugcucgggaugcugguggccuccugccugggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2226 - RNA, 769 nt, Artificial Sequence
  VP8* aa65-223short P[4] SP(HLA-A2) mRNA opt Design1
gggagaaagcuuaccauggccgugauggccccgcggacccugguccuccugcugagcggcgcgcucgcccugacccagacgugggcccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2227 - RNA, 769 nt, Artificial Sequence
  VP8* aa65-223short P[6] SP(HLA-A2) mRNA opt Design1
gggagaaagcuuaccauggccgugauggccccgcggacccugguccuccugcugagcggcgcgcucgcccugacccagacgugggcccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2228 - RNA, 769 nt, Artificial Sequence
  VP8* aa65-223 short P[8] SP(HLA-A2) mRNA opt Design1
gggagaaagcuuaccauggccgugauggccccgcggacccugguccuccugcugagcggcgcgcucgcccugacccagacgugggcccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2229 - RNA, 769 nt, Artificial Sequence
  VP8* aa65-223short P[8]-VirWa SP(HLA-A2) mRNA opt Design1
gggagaaagcuuaccauggccgugauggccccgcggacccugguccuccugcugagcggcgcgcucgcccugacccagacgugggcccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2230 - RNA, 820 nt, Artificial Sequence
  VP8* aa65-223short P[4] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2231 - RNA, 820 nt, Artificial Sequence
  VP8* aa65-223short P[6] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2232 - RNA, 820 nt, Artificial Sequence
  VP8* aa65-223 short P[8] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2233 - RNA, 820 nt, Artificial Sequence
  VP8* aa65-223short P[8]-VirWa SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2234 - RNA, 811 nt, Artificial Sequence
  VP8* aa65-223short P[4] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2235 - RNA, 811 nt, Artificial Sequence
  VP8* aa65-223short P[6] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2236 - RNA, 811 nt, Artificial Sequence
  VP8* aa65-223 short P[8] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2237 - RNA, 811 nt, Artificial Sequence
  VP8* aa65-223short P[8]-VirWa SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2238 - RNA, 811 nt, Artificial Sequence
  VP8* aa65-223short P[4] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2239 - RNA, 811 nt, Artificial Sequence
  VP8* aa65-223short P[6] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2240 - RNA, 811 nt, Artificial Sequence
  VP8* aa65-223 short P[8] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2241 - RNA, 811 nt, Artificial Sequence
  VP8* aa65-223short P[8]-VirWa SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2242 - RNA, 829 nt, Artificial Sequence
  VP8* aa65-223short P[4] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2243 - RNA, 829 nt, Artificial Sequence
  VP8* aa65-223short P[6] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2244 - RNA, 829 nt, Artificial Sequence
  VP8* aa65-223 short P[8] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2245 - RNA, 829 nt, Artificial Sequence
  VP8* aa65-223short P[8]-VirWa SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2246 - RNA, 829 nt, Artificial Sequence
  VP8* aa65-223short P[4] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2247 - RNA, 829 nt, Artificial Sequence
  VP8* aa65-223short P[6] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2248 - RNA, 829 nt, Artificial Sequence
  VP8* aa65-223 short P[8] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2249 - RNA, 829 nt, Artificial Sequence
  VP8* aa65-223short P[8]-VirWa SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2250 - RNA, 700 nt, Artificial Sequence
  VP8* aa65-223short P[4] w/o glyco mRNA opt Design1
gggagaaagcuuaccaugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2251 - RNA, 700 nt, Artificial Sequence
  VP8* aa65-223short P[6] w/o glyco mRNA opt Design1
gggagaaagcuuaccaugcucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2252 - RNA, 700 nt, Artificial Sequence
  VP8* aa65-223 short P[8] w/o glyco mRNA opt Design1
gggagaaagcuuaccaugcucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2253 - RNA, 700 nt, Artificial Sequence
  VP8* aa65-223short P[8]-VirWa w/o glyco mRNA opt Design1
gggagaaagcuuaccaugcucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2254 - RNA, 760 nt, Artificial Sequence
  VP8* aa65-223short P[4] P2+Linker w/o glyco mRNA opt Design1
gggagaaagcuuaccaugcaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2255 - RNA, 760 nt, Artificial Sequence
  VP8* aa65-223short P[6] P2+Linker w/o glyco mRNA opt Design1
gggagaaagcuuaccaugcaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2256 - RNA, 760 nt, Artificial Sequence
  VP8* aa65-223 short P[8] P2+Linker w/o glyco mRNA opt Design1
gggagaaagcuuaccaugcaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2257 - RNA, 760 nt, Artificial Sequence
  VP8* aa65-223short P[8]-VirWa P2+Linker w/o glyco mRNA opt Design1
gggagaaagcuuaccaugcaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2258 - RNA, 760 nt, Artificial Sequence
  VP8* aa65-223short P[4] SP(TPA) w/o glyco mRNA opt Design1
gggagaaagcuuaccauggacgccaugaagcgcggccugugcugcgugcuccugcugugcggggccgucuucgugagccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2259 - RNA, 760 nt, Artificial Sequence
  VP8* aa65-223short P[6] SP(TPA) w/o glyco mRNA opt Design1
gggagaaagcuuaccauggacgccaugaagcgcggccugugcugcgugcuccugcugugcggggccgucuucgugagccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2260 - RNA, 760 nt, Artificial Sequence
  VP8* aa65-223 short P[8] SP(TPA) w/o glyco mRNA opt Design1
gggagaaagcuuaccauggacgccaugaagcgcggccugugcugcgugcuccugcugugcggggccgucuucgugagccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2261 - RNA, 760 nt, Artificial Sequence
  VP8* aa65-223short P[8]-VirWa SP(TPA) w/o glyco mRNA opt Design1
gggagaaagcuuaccauggacgccaugaagcgcggccugugcugcgugcuccugcugugcggggccgucuucgugagccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2262 - RNA, 751 nt, Artificial Sequence
  VP8* aa65-223short P[4] SP(HSA) w/o glyco mRNA opt Design1
gggagaaagcuuaccaugaagugggugaccuucaucagccugcucuuccuguucuccagcgccuacucccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2263 - RNA, 751 nt, Artificial Sequence
  VP8* aa65-223short P[6] SP(HSA) w/o glyco mRNA opt Design1
gggagaaagcuuaccaugaagugggugaccuucaucagccugcucuuccuguucuccagcgccuacucccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2264 - RNA, 751 nt, Artificial Sequence
  VP8* aa65-223 short P[8] SP(HSA) w/o glyco mRNA opt Design1
gggagaaagcuuaccaugaagugggugaccuucaucagccugcucuuccuguucuccagcgccuacucccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2265 - RNA, 751 nt, Artificial Sequence
  VP8* aa65-223short P[8]-VirWa SP(HSA) w/o glyco mRNA opt Design1
gggagaaagcuuaccaugaagugggugaccuucaucagccugcucuuccuguucuccagcgccuacucccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2266 - RNA, 751 nt, Artificial Sequence
  VP8* aa65-223short P[4] SP(IgE) w/o glyco mRNA opt Design1
gggagaaagcuuaccauggacuggaccuggauccuguuccucguggccgccgcgacccgcguccacagccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2267 - RNA, 751 nt, Artificial Sequence
  VP8* aa65-223short P[6] SP(IgE) w/o glyco mRNA opt Design1
gggagaaagcuuaccauggacuggaccuggauccuguuccucguggccgccgcgacccgcguccacagccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2268 - RNA, 751 nt, Artificial Sequence
  VP8* aa65-223 short P[8] SP(IgE) w/o glyco mRNA opt Design1
gggagaaagcuuaccauggacuggaccuggauccuguuccucguggccgccgcgacccgcguccacagccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2269 - RNA, 751 nt, Artificial Sequence
  VP8* aa65-223short P[8]-VirWa SP(IgE) w/o glyco mRNA opt Design1
gggagaaagcuuaccauggacuggaccuggauccuguuccucguggccgccgcgacccgcguccacagccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2270 - RNA, 769 nt, Artificial Sequence
  VP8* aa65-223short P[4] SP(CD5) w/o glyco mRNA opt Design1
gggagaaagcuuaccaugcccaugggcagccugcagccgcucgccacccuguaccugcucgggaugcugguggccuccugccugggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2271 - RNA, 769 nt, Artificial Sequence
  VP8* aa65-223short P[6] SP(CD5) w/o glyco mRNA opt Design1
gggagaaagcuuaccaugcccaugggcagccugcagccgcucgccacccuguaccugcucgggaugcugguggccuccugccugggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2272 - RNA, 769 nt, Artificial Sequence
  VP8* aa65-223 short P[8] SP(CD5) w/o glyco mRNA opt Design1
gggagaaagcuuaccaugcccaugggcagccugcagccgcucgccacccuguaccugcucgggaugcugguggccuccugccugggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2273 - RNA, 769 nt, Artificial Sequence
  VP8* aa65-223short P[8]-VirWa SP(CD5) w/o glyco mRNA opt Design1
gggagaaagcuuaccaugcccaugggcagccugcagccgcucgccacccuguaccugcucgggaugcugguggccuccugccugggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2274 - RNA, 769 nt, Artificial Sequence
  VP8* aa65-223short P[4] SP(HLA-A2) w/o glyco mRNA opt Design1
gggagaaagcuuaccauggccgugauggccccgcggacccugguccuccugcugagcggcgcgcucgcccugacccagacgugggcccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2275 - RNA, 769 nt, Artificial Sequence
  VP8* aa65-223short P[6] SP(HLA-A2) w/o glyco mRNA opt Design1
gggagaaagcuuaccauggccgugauggccccgcggacccugguccuccugcugagcggcgcgcucgcccugacccagacgugggcccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2276 - RNA, 769 nt, Artificial Sequence
  VP8* aa65-223 short P[8] SP(HLA-A2) w/o glyco mRNA opt Design1
gggagaaagcuuaccauggccgugauggccccgcggacccugguccuccugcugagcggcgcgcucgcccugacccagacgugggcccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2277 - RNA, 769 nt, Artificial Sequence
  VP8* aa65-223short P[8]-VirWa SP(HLA-A2) w/o glyco mRNA opt Design1
gggagaaagcuuaccauggccgugauggccccgcggacccugguccuccugcugagcggcgcgcucgcccugacccagacgugggcccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2278 - RNA, 820 nt, Artificial Sequence
  VP8* aa65-223short P[4] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2279 - RNA, 820 nt, Artificial Sequence
  VP8* aa65-223short P[6] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2280 - RNA, 820 nt, Artificial Sequence
  VP8* aa65-223 short P[8] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2281 - RNA, 820 nt, Artificial Sequence
  VP8* aa65-223short P[8]-VirWa SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2282 - RNA, 811 nt, Artificial Sequence
  VP8* aa65-223short P[4] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2283 - RNA, 811 nt, Artificial Sequence
  VP8* aa65-223short P[6] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2284 - RNA, 811 nt, Artificial Sequence
  VP8* aa65-223 short P[8] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2285 - RNA, 811 nt, Artificial Sequence
  VP8* aa65-223short P[8]-VirWa SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2286 - RNA, 811 nt, Artificial Sequence
  VP8* aa65-223short P[4] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2287 - RNA, 811 nt, Artificial Sequence
  VP8* aa65-223short P[6] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2288 - RNA, 811 nt, Artificial Sequence
  VP8* aa65-223 short P[8] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2289 - RNA, 811 nt, Artificial Sequence
  VP8* aa65-223short P[8]-VirWa SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2290 - RNA, 829 nt, Artificial Sequence
  VP8* aa65-223short P[4] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2291 - RNA, 829 nt, Artificial Sequence
  VP8* aa65-223short P[6] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2292 - RNA, 829 nt, Artificial Sequence
  VP8* aa65-223 short P[8] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2293 - RNA, 829 nt, Artificial Sequence
  VP8* aa65-223short P[8]-VirWa SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2294 - RNA, 829 nt, Artificial Sequence
  VP8* aa65-223short P[4] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2295 - RNA, 829 nt, Artificial Sequence
  VP8* aa65-223short P[6] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2296 - RNA, 829 nt, Artificial Sequence
  VP8* aa65-223 short P[8] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2297 - RNA, 829 nt, Artificial Sequence
  VP8* aa65-223short P[8]-VirWa SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2298 - RNA, 703 nt, Artificial Sequence
  VP8* aa64-223short P[4] mRNA opt Design1
gggagaaagcuuaccauggugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2299 - RNA, 703 nt, Artificial Sequence
  VP8* aa64-223short P[6] mRNA opt Design1
gggagaaagcuuaccaugguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2300 - RNA, 763 nt, Artificial Sequence
  VP8* aa64-223short P[4] P2+Linker mRNA opt Design1
gggagaaagcuuaccaugcaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2301 - RNA, 763 nt, Artificial Sequence
  VP8* aa64-223short P[6] P2+Linker mRNA opt Design1
gggagaaagcuuaccaugcaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2302 - RNA, 763 nt, Artificial Sequence
  VP8* aa64-223short P[4] SP(TPA) mRNA opt Design1
gggagaaagcuuaccauggacgccaugaagcgcggccugugcugcgugcuccugcugugcggggccgucuucgugagcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2303 - RNA, 763 nt, Artificial Sequence
  VP8* aa64-223short P[6] SP(TPA) mRNA opt Design1
gggagaaagcuuaccauggacgccaugaagcgcggccugugcugcgugcuccugcugugcggggccgucuucgugagcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2304 - RNA, 754 nt, Artificial Sequence
  VP8* aa64-223short P[4] SP(HSA) mRNA opt Design1
gggagaaagcuuaccaugaagugggugaccuucaucagccugcucuuccuguucuccagcgccuacuccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2305 - RNA, 754 nt, Artificial Sequence
  VP8* aa64-223short P[6] SP(HSA) mRNA opt Design1
gggagaaagcuuaccaugaagugggugaccuucaucagccugcucuuccuguucuccagcgccuacuccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2306 - RNA, 754 nt, Artificial Sequence
  VP8* aa64-223short P[4] SP(IgE) mRNA opt Design1
gggagaaagcuuaccauggacuggaccuggauccuguuccucguggccgccgcgacccgcguccacagcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2307 - RNA, 754 nt, Artificial Sequence
  VP8* aa64-223short P[6] SP(IgE) mRNA opt Design1
gggagaaagcuuaccauggacuggaccuggauccuguuccucguggccgccgcgacccgcguccacagcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2308 - RNA, 772 nt, Artificial Sequence
  VP8* aa64-223short P[4] SP(CD5) mRNA opt Design1
gggagaaagcuuaccaugcccaugggcagccugcagccgcucgccacccuguaccugcucgggaugcugguggccuccugccugggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2309 - RNA, 772 nt, Artificial Sequence
  VP8* aa64-223short P[6] SP(CD5) mRNA opt Design1
gggagaaagcuuaccaugcccaugggcagccugcagccgcucgccacccuguaccugcucgggaugcugguggccuccugccugggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2310 - RNA, 772 nt, Artificial Sequence
  VP8* aa64-223short P[4] SP(HLA-A2) mRNA opt Design1
gggagaaagcuuaccauggccgugauggccccgcggacccugguccuccugcugagcggcgcgcucgcccugacccagacgugggccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2311 - RNA, 772 nt, Artificial Sequence
  VP8* aa64-223short P[6] SP(HLA-A2) mRNA opt Design1
gggagaaagcuuaccauggccgugauggccccgcggacccugguccuccugcugagcggcgcgcucgcccugacccagacgugggccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2312 - RNA, 823 nt, Artificial Sequence
  VP8* aa64-223short P[4] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2313 - RNA, 823 nt, Artificial Sequence
  VP8* aa64-223short P[6] SP(TPA)+P2+Linker mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2314 - RNA, 814 nt, Artificial Sequence
  VP8* aa64-223short P[4] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2315 - RNA, 814 nt, Artificial Sequence
  VP8* aa64-223short P[6] SP(HSA)+P2+Linker mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2316 - RNA, 814 nt, Artificial Sequence
  VP8* aa64-223short P[4] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2317 - RNA, 814 nt, Artificial Sequence
  VP8* aa64-223short P[6] SP(IgE)+P2+Linker mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2318 - RNA, 832 nt, Artificial Sequence
  VP8* aa64-223short P[4] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2319 - RNA, 832 nt, Artificial Sequence
  VP8* aa64-223short P[6] SP(CD5)+P2+Linker mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2320 - RNA, 832 nt, Artificial Sequence
  VP8* aa64-223short P[4] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2321 - RNA, 832 nt, Artificial Sequence
  VP8* aa64-223short P[6] SP(HLA-A2)+P2+Linker mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2322 - RNA, 703 nt, Artificial Sequence
  VP8* aa64-223short P[4] w/o glyco mRNA opt Design1
gggagaaagcuuaccauggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2323 - RNA, 703 nt, Artificial Sequence
  VP8* aa64-223short P[6] w/o glyco mRNA opt Design1
gggagaaagcuuaccaugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2324 - RNA, 763 nt, Artificial Sequence
  VP8* aa64-223short P[4] P2+Linker w/o glyco mRNA opt Design1
gggagaaagcuuaccaugcaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2325 - RNA, 763 nt, Artificial Sequence
  VP8* aa64-223short P[6] P2+Linker w/o glyco mRNA opt Design1
gggagaaagcuuaccaugcaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2326 - RNA, 763 nt, Artificial Sequence
  VP8* aa64-223short P[4] SP(TPA) w/o glyco mRNA opt Design1
gggagaaagcuuaccauggacgccaugaagcgcggccugugcugcgugcuccugcugugcggggccgucuucgugagcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2327 - RNA, 763 nt, Artificial Sequence
  VP8* aa64-223short P[6] SP(TPA) w/o glyco mRNA opt Design1
gggagaaagcuuaccauggacgccaugaagcgcggccugugcugcgugcuccugcugugcggggccgucuucgugagcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2328 - RNA, 754 nt, Artificial Sequence
  VP8* aa64-223short P[4] SP(HSA) w/o glyco mRNA opt Design1
gggagaaagcuuaccaugaagugggugaccuucaucagccugcucuuccuguucuccagcgccuacuccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2329 - RNA, 754 nt, Artificial Sequence
  VP8* aa64-223short P[6] SP(HSA) w/o glyco mRNA opt Design1
gggagaaagcuuaccaugaagugggugaccuucaucagccugcucuuccuguucuccagcgccuacuccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2330 - RNA, 754 nt, Artificial Sequence
  VP8* aa64-223short P[4] SP(IgE) w/o glyco mRNA opt Design1
gggagaaagcuuaccauggacuggaccuggauccuguuccucguggccgccgcgacccgcguccacagcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2331 - RNA, 754 nt, Artificial Sequence
  VP8* aa64-223short P[6] SP(IgE) w/o glyco mRNA opt Design1
gggagaaagcuuaccauggacuggaccuggauccuguuccucguggccgccgcgacccgcguccacagcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2332 - RNA, 772 nt, Artificial Sequence
  VP8* aa64-223short P[4] SP(CD5) w/o glyco mRNA opt Design1
gggagaaagcuuaccaugcccaugggcagccugcagccgcucgccacccuguaccugcucgggaugcugguggccuccugccugggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2333 - RNA, 772 nt, Artificial Sequence
  VP8* aa64-223short P[6] SP(CD5) w/o glyco mRNA opt Design1
gggagaaagcuuaccaugcccaugggcagccugcagccgcucgccacccuguaccugcucgggaugcugguggccuccugccugggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2334 - RNA, 772 nt, Artificial Sequence
  VP8* aa64-223short P[4] SP(HLA-A2) w/o glyco mRNA opt Design1
gggagaaagcuuaccauggccgugauggccccgcggacccugguccuccugcugagcggcgcgcucgcccugacccagacgugggccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2335 - RNA, 772 nt, Artificial Sequence
  VP8* aa64-223short P[6] SP(HLA-A2) w/o glyco mRNA opt Design1
gggagaaagcuuaccauggccgugauggccccgcggacccugguccuccugcugagcggcgcgcucgcccugacccagacgugggccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2336 - RNA, 823 nt, Artificial Sequence
  VP8* aa64-223short P[4] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2337 - RNA, 823 nt, Artificial Sequence
  VP8* aa64-223short P[6] SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2338 - RNA, 814 nt, Artificial Sequence
  VP8* aa64-223short P[4] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2339 - RNA, 814 nt, Artificial Sequence
  VP8* aa64-223short P[6] SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2340 - RNA, 814 nt, Artificial Sequence
  VP8* aa64-223short P[4] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2341 - RNA, 814 nt, Artificial Sequence
  VP8* aa64-223short P[6] SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2342 - RNA, 832 nt, Artificial Sequence
  VP8* aa64-223short P[4] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2343 - RNA, 832 nt, Artificial Sequence
  VP8* aa64-223short P[6] SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2344 - RNA, 832 nt, Artificial Sequence
  VP8* aa64-223short P[4] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2345 - RNA, 832 nt, Artificial Sequence
  VP8* aa64-223short P[6] SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2346 - RNA, 985 nt, Artificial Sequence
  P2 VP8* P[4]-long mRNA opt Design1
gggagaaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2347 - RNA, 985 nt, Artificial Sequence
  P2 VP8* P[6]-long mRNA opt Design1
gggagaaagcuuaccaugcaguacaucaaggccaacagcaaguucaucggcaucaccgagcuggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2348 - RNA, 985 nt, Artificial Sequence
  P2 VP8* P[8]-long mRNA opt Design1
gggagaaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2349 - RNA, 748 nt, Artificial Sequence
  P2 VP8* P[4]-short mRNA opt Design1
gggagaaagcuuaccaugcaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2350 - RNA, 748 nt, Artificial Sequence
  P2 VP8* P[6]-short mRNA opt Design1
gggagaaagcuuaccaugcaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2351 - RNA, 745 nt, Artificial Sequence
  P2 VP8* P[8]-short mRNA opt Design1
gggagaaagcuuaccaugcaguacaucaaggccaacagcaaguucaucggcaucaccgagcugcucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2352 - RNA, 745 nt, Artificial Sequence
  P2 VP8* P[8]-WA-VirWa-short mRNA opt Design1
gggagaaagcuuaccaugcaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2353 - RNA, 1045 nt, Artificial Sequence
  SP P2 VP8* P[4]-long w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2354 - RNA, 1045 nt, Artificial Sequence
  SP P2 VP8* P[6]-long w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2355 - RNA, 1045 nt, Artificial Sequence
  SP P2 VP8* P[8]-long w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2356 - RNA, 808 nt, Artificial Sequence
  SP P2 VP8* P[4]-short w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2357 - RNA, 808 nt, Artificial Sequence
  SP P2 VP8* P[6]-short w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2358 - RNA, 805 nt, Artificial Sequence
  SP P2 VP8* P[8]-short w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugcucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2359 - RNA, 805 nt, Artificial Sequence
  SP P2 VP8* P[8]-WA-VirWa-short w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgcagaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2360 - RNA, 1183 nt, Artificial Sequence
  SP P2 VP8* P[4]-long w/o glyco w TM domain mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2361 - RNA, 1183 nt, Artificial Sequence
  SP P2 VP8* P[6]-long w/o glyco w TM domain mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2362 - RNA, 1183 nt, Artificial Sequence
  SP P2 VP8* P[8]-long w/o glyco w TM domain mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2363 - RNA, 946 nt, Artificial Sequence
  SP P2 VP8* P[4]-short w/o glyco w TM domain mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2364 - RNA, 946 nt, Artificial Sequence
  SP P2 VP8* P[6]-short w/o glyco w TM domain mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2365 - RNA, 943 nt, Artificial Sequence
  SP P2 VP8* P[8]-short w/o glyco w TM domain mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugcucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2366 - RNA, 943 nt, Artificial Sequence
  SP P2 VP8* P[8]-WA-VirWa-short w/o glyco w TM domain mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgcagaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaacaacgggcugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2367 - RNA, 1519 nt, Artificial Sequence
  SP VLP peptide linker P2 VP8* P[4]-long w/o glyco mRNA opt Design1
gggagaaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2368 - RNA, 1519 nt, Artificial Sequence
  SP VLP peptide linker P2 VP8* P[6]-long w/o glyco mRNA opt Design1
gggagaaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2369 - RNA, 1519 nt, Artificial Sequence
  SP VLP peptide linker P2 VP8* P[8]-long w/o glyco mRNA opt Design1
gggagaaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2370 - RNA, 1282 nt, Artificial Sequence
  SP VLP peptide linker P2 VP8* P[4]-short w/o glyco mRNA opt Design1
gggagaaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2371 - RNA, 1282 nt, Artificial Sequence
  SP VLP peptide linker P2 VP8* P[6]-short w/o glyco mRNA opt Design1
gggagaaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2372 - RNA, 1279 nt, Artificial Sequence
  SP VLP peptide linker P2 VP8* P[8]-short w/o glyco mRNA opt Design1
gggagaaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcugcucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2373 - RNA, 1279 nt, Artificial Sequence
  SP VLP peptide linker P2 VP8* P[8]-Wa-VirWa-short w/o glyco mRNA opt Design1
gggagaaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgcagaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaacaacgggcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2374 - RNA, 3331 nt, Artificial Sequence
  SP 4x(P2 VP8* P[4]-long w/o glyco) mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2375 - RNA, 3331 nt, Artificial Sequence
  SP 4x(P2 VP8* P[6]-long w/o glyco) mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcaggucgugcucgagggcacgcagaagaccgacaucuggguggcccugcugcucguggagccgcaggucaccaaccagagccggcaguacacccuguucggggagacgaagcagaucaccguggagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcaggucgugcucgagggcacgcagaagaccgacaucuggguggcccugcugcucguggagccgcaggucaccaaccagagccggcaguacacccuguucggggagacgaagcagaucaccguggagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcaggucgugcucgagggcacgcagaagaccgacaucuggguggcccugcugcucguggagccgcaggucaccaaccagagccggcaguacacccuguucggggagacgaagcagaucaccguggagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcaggucgugcucgagggcacgcagaagaccgacaucuggguggcccugcugcucguggagccgcaggucaccaaccagagccggcaguacacccuguucggggagacgaagcagaucaccguggagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2376 - RNA, 3331 nt, Artificial Sequence
  SP 4x(P2 VP8* P[8]-long w/o glyco) mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2377 - RNA, 3863 nt, Artificial Sequence
  multicistronic P2 P[8]-[6]-[4]-long EMCV-IRES-4 mRNA opt Design1
gggagaaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugcaguacaucaaggccaacagcaaguucaucggcaucaccgagcuggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2378 - RNA, 3443 nt, Artificial Sequence
  multicistronic P2 P[8]-[6]-[4]-long FMDV-IRES mRNA opt Design1
gggagaaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuaugcaguacaucaaggccaacagcaaguucaucggcaucaccgagcuggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2379 - RNA, 2647 nt, Artificial Sequence
  multicistronic P2 P[4]-[6]-[8]-long F2A mRNA opt Design1
gggagaaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcgugaagcagacacucaauuucgaccuucugaaguuggcuggagauguugagucuaacccaggccccaugcaguacaucaaggccaacagcaaguucaucggcaucaccgagcuggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcgucaaacagaccuugaacuucgacuugcucaaacuggccggggauguggaguccaauccuggaccuaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2380 - RNA, 4043 nt, Artificial Sequence
  multicistronic SP P2 P[8]-[6]-[4]-long w/o glyco EMCV-IRES-4 mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2381 - RNA, 3623 nt, Artificial Sequence
  multicistronic SP P2 P[8]-[6]-[4]-long w/o glyco FMDV-IRES mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2382 - RNA, 2827 nt, Artificial Sequence
  multicistronic SP P2 P[4]-[6]-[8]-long w/o glyco F2A mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcgugaagcagacacucaauuucgaccuucugaaguuggcuggagauguugagucuaacccaggccccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcgucaaacagaccuugaacuucgacuugcucaaacuggccggggauguggaguccaauccuggaccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2383 - RNA, 4457 nt, Artificial Sequence
  multicistronic SP P2 P[8]-[6]-[4]-long w/o glyco w TM domain EMCV-IRES-4 mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2384 - RNA, 4037 nt, Artificial Sequence
  multicistronic SP P2 P[8]-[6]-[4]-long w/o glyco w TM domain FMDV-IRES mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2385 - RNA, 3241 nt, Artificial Sequence
  multicistronic SP P2 P[4]-[6]-[8]-long w/o glyco w TM domain F2A mRNA opt Design1
gggagaaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucgugaagcagacacucaauuucgaccuucugaaguuggcuggagauguugagucuaacccaggccccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucgucaaacagaccuugaacuucgacuugcucaaacuggccggggauguggaguccaauccuggaccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2386 - RNA, 1105 nt, Artificial Sequence
  VP8* aa2-240 long P[4] mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2387 - RNA, 1105 nt, Artificial Sequence
  VP8* aa2-240 long P[6] mRNA opt Design2
ggggcgcugccuacggagguggcagccaucuccuucucggcaucaagcuuaccauggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2388 - RNA, 1105 nt, Artificial Sequence
  VP8* aa2-240 long P[8] mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2389 - RNA, 1105 nt, Artificial Sequence
  VP8* aa2-240 long P[8]-VirWa mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2390 - RNA, 1165 nt, Artificial Sequence
  VP8* aa2-240 long P[4] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2391 - RNA, 1165 nt, Artificial Sequence
  VP8* aa2-240 long P[6] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2392 - RNA, 1165 nt, Artificial Sequence
  VP8* aa2-240 long P[8] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2393 - RNA, 1165 nt, Artificial Sequence
  VP8* aa2-240 long P[8]-VirWa P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2394 - RNA, 1165 nt, Artificial Sequence
  VP8* aa2-240 long P[4] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2395 - RNA, 1165 nt, Artificial Sequence
  VP8* aa2-240 long P[6] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2396 - RNA, 1165 nt, Artificial Sequence
  VP8* aa2-240 long P[8] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2397 - RNA, 1165 nt, Artificial Sequence
  VP8* aa2-240 long P[8]-VirWa SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2398 - RNA, 1156 nt, Artificial Sequence
  VP8* aa2-240 long P[4] SP(HSA) mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2399 - RNA, 1156 nt, Artificial Sequence
  VP8* aa2-240 long P[6] SP(HSA) mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2400 - RNA, 1156 nt, Artificial Sequence
  VP8* aa2-240 long P[8] SP(HSA) mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2401 - RNA, 1156 nt, Artificial Sequence
  VP8* aa2-240 long P[8]-VirWa SP(HSA) mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2402 - RNA, 1156 nt, Artificial Sequence
  VP8* aa2-240 long P[4] SP(IgE) mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2403 - RNA, 1156 nt, Artificial Sequence
  VP8* aa2-240 long P[6] SP(IgE) mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2404 - RNA, 1156 nt, Artificial Sequence
  VP8* aa2-240 long P[8] SP(IgE) mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2405 - RNA, 1156 nt, Artificial Sequence
  VP8* aa2-240 long P[8]-VirWa SP(IgE) mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2406 - RNA, 1174 nt, Artificial Sequence
  VP8* aa2-240 long P[4] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2407 - RNA, 1174 nt, Artificial Sequence
  VP8* aa2-240 long P[6] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2408 - RNA, 1174 nt, Artificial Sequence
  VP8* aa2-240 long P[8] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2409 - RNA, 1174 nt, Artificial Sequence
  VP8* aa2-240 long P[8]-VirWa SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2410 - RNA, 1174 nt, Artificial Sequence
  VP8* aa2-240 long P[4] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2411 - RNA, 1174 nt, Artificial Sequence
  VP8* aa2-240 long P[6] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2412 - RNA, 1174 nt, Artificial Sequence
  VP8* aa2-240 long P[8] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2413 - RNA, 1174 nt, Artificial Sequence
  VP8* aa2-240 long P[8]-VirWa SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2414 - RNA, 1225 nt, Artificial Sequence
  VP8* aa2-240 long P[4] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2415 - RNA, 1225 nt, Artificial Sequence
  VP8* aa2-240 long P[6] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2416 - RNA, 1225 nt, Artificial Sequence
  VP8* aa2-240 long P[8] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2417 - RNA, 1225 nt, Artificial Sequence
  VP8* aa2-240 long P[8]-VirWa SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2418 - RNA, 1216 nt, Artificial Sequence
  VP8* aa2-240 long P[4] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2419 - RNA, 1216 nt, Artificial Sequence
  VP8* aa2-240 long P[6] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2420 - RNA, 1216 nt, Artificial Sequence
  VP8* aa2-240 long P[8] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2421 - RNA, 1216 nt, Artificial Sequence
  VP8* aa2-240 long P[8]-VirWa SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2422 - RNA, 1216 nt, Artificial Sequence
  VP8* aa2-240 long P[4] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2423 - RNA, 1216 nt, Artificial Sequence
  VP8* aa2-240 long P[6] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2424 - RNA, 1216 nt, Artificial Sequence
  VP8* aa2-240 long P[8] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2425 - RNA, 1216 nt, Artificial Sequence
  VP8* aa2-240 long P[8]-VirWa SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2426 - RNA, 1234 nt, Artificial Sequence
  VP8* aa2-240 long P[4] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2427 - RNA, 1234 nt, Artificial Sequence
  VP8* aa2-240 long P[6] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2428 - RNA, 1234 nt, Artificial Sequence
  VP8* aa2-240 long P[8] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2429 - RNA, 1234 nt, Artificial Sequence
  VP8* aa2-240 long P[8]-VirWa SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2430 - RNA, 1234 nt, Artificial Sequence
  VP8* aa2-240 long P[4] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2431 - RNA, 1234 nt, Artificial Sequence
  VP8* aa2-240 long P[6] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2432 - RNA, 1234 nt, Artificial Sequence
  VP8* aa2-240 long P[8] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2433 - RNA, 1234 nt, Artificial Sequence
  VP8* aa2-240 long P[8]-VirWa SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2434 - RNA, 1105 nt, Artificial Sequence
  VP8* aa2-240 long P[4] w/o glyco mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2435 - RNA, 1105 nt, Artificial Sequence
  VP8* aa2-240 long P[6] w/o glyco mRNA opt Design2
ggggcgcugccuacggagguggcagccaucuccuucucggcaucaagcuuaccauggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2436 - RNA, 1105 nt, Artificial Sequence
  VP8* aa2-240 long P[8] w/o glyco mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2437 - RNA, 1105 nt, Artificial Sequence
  VP8* aa2-240 long P[8]-VirWa w/o glyco mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2438 - RNA, 1165 nt, Artificial Sequence
  VP8* aa2-240 long P[4] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2439 - RNA, 1165 nt, Artificial Sequence
  VP8* aa2-240 long P[6] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2440 - RNA, 1165 nt, Artificial Sequence
  VP8* aa2-240 long P[8] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2441 - RNA, 1165 nt, Artificial Sequence
  VP8* aa2-240 long P[8]-VirWa P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2442 - RNA, 1165 nt, Artificial Sequence
  VP8* aa2-240 long P[4] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2443 - RNA, 1165 nt, Artificial Sequence
  VP8* aa2-240 long P[6] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2444 - RNA, 1165 nt, Artificial Sequence
  VP8* aa2-240 long P[8] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2445 - RNA, 1165 nt, Artificial Sequence
  VP8* aa2-240 long P[8]-VirWa SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2446 - RNA, 1156 nt, Artificial Sequence
  VP8* aa2-240 long P[4] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2447 - RNA, 1156 nt, Artificial Sequence
  VP8* aa2-240 long P[6] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2448 - RNA, 1156 nt, Artificial Sequence
  VP8* aa2-240 long P[8] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2449 - RNA, 1156 nt, Artificial Sequence
  VP8* aa2-240 long P[8]-VirWa SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2450 - RNA, 1156 nt, Artificial Sequence
  VP8* aa2-240 long P[4] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2451 - RNA, 1156 nt, Artificial Sequence
  VP8* aa2-240 long P[6] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2452 - RNA, 1156 nt, Artificial Sequence
  VP8* aa2-240 long P[8] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2453 - RNA, 1156 nt, Artificial Sequence
  VP8* aa2-240 long P[8]-VirWa SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2454 - RNA, 1174 nt, Artificial Sequence
  VP8* aa2-240 long P[4] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2455 - RNA, 1174 nt, Artificial Sequence
  VP8* aa2-240 long P[6] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2456 - RNA, 1174 nt, Artificial Sequence
  VP8* aa2-240 long P[8] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2457 - RNA, 1174 nt, Artificial Sequence
  VP8* aa2-240 long P[8]-VirWa SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2458 - RNA, 1174 nt, Artificial Sequence
  VP8* aa2-240 long P[4] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2459 - RNA, 1174 nt, Artificial Sequence
  VP8* aa2-240 long P[6] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2460 - RNA, 1174 nt, Artificial Sequence
  VP8* aa2-240 long P[8] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2461 - RNA, 1174 nt, Artificial Sequence
  VP8* aa2-240 long P[8]-VirWa SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2462 - RNA, 1225 nt, Artificial Sequence
  VP8* aa2-240 long P[4] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2463 - RNA, 1225 nt, Artificial Sequence
  VP8* aa2-240 long P[6] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2464 - RNA, 1225 nt, Artificial Sequence
  VP8* aa2-240 long P[8] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2465 - RNA, 1225 nt, Artificial Sequence
  VP8* aa2-240 long P[8]-VirWa SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2466 - RNA, 1216 nt, Artificial Sequence
  VP8* aa2-240 long P[4] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2467 - RNA, 1216 nt, Artificial Sequence
  VP8* aa2-240 long P[6] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2468 - RNA, 1216 nt, Artificial Sequence
  VP8* aa2-240 long P[8] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2469 - RNA, 1216 nt, Artificial Sequence
  VP8* aa2-240 long P[8]-VirWa SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2470 - RNA, 1216 nt, Artificial Sequence
  VP8* aa2-240 long P[4] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2471 - RNA, 1216 nt, Artificial Sequence
  VP8* aa2-240 long P[6] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2472 - RNA, 1216 nt, Artificial Sequence
  VP8* aa2-240 long P[8] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2473 - RNA, 1216 nt, Artificial Sequence
  VP8* aa2-240 long P[8]-VirWa SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2474 - RNA, 1234 nt, Artificial Sequence
  VP8* aa2-240 long P[4] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2475 - RNA, 1234 nt, Artificial Sequence
  VP8* aa2-240 long P[6] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2476 - RNA, 1234 nt, Artificial Sequence
  VP8* aa2-240 long P[8] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2477 - RNA, 1234 nt, Artificial Sequence
  VP8* aa2-240 long P[8]-VirWa SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2478 - RNA, 1234 nt, Artificial Sequence
  VP8* aa2-240 long P[4] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2479 - RNA, 1234 nt, Artificial Sequence
  VP8* aa2-240 long P[6] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2480 - RNA, 1234 nt, Artificial Sequence
  VP8* aa2-240 long P[8] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2481 - RNA, 1234 nt, Artificial Sequence
  VP8* aa2-240 long P[8]-VirWa SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2482 - RNA, 1075 nt, Artificial Sequence
  VP8* aa2-230 P[4] mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2483 - RNA, 1075 nt, Artificial Sequence
  VP8* aa2-230 P[6] mRNA opt Design2
ggggcgcugccuacggagguggcagccaucuccuucucggcaucaagcuuaccauggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2484 - RNA, 1075 nt, Artificial Sequence
  R5477/R5479 VP8* aa2-230 P[8] mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2485 - RNA, 1075 nt, Artificial Sequence
  VP8* aa2-230 P[8]-VirWa mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2486 - RNA, 1135 nt, Artificial Sequence
  VP8* aa2-230 P[4] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2487 - RNA, 1135 nt, Artificial Sequence
  VP8* aa2-230 P[6] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2488 - RNA, 1135 nt, Artificial Sequence
  R5474/R5475 VP8* aa2-230 P[8] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2489 - RNA, 1135 nt, Artificial Sequence
  VP8* aa2-230 P[8]-VirWa P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2490 - RNA, 1135 nt, Artificial Sequence
  VP8* aa2-230 P[4] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2491 - RNA, 1135 nt, Artificial Sequence
  R5435/R5596 VP8* aa2-230 P[6] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2492 - RNA, 1135 nt, Artificial Sequence
  VP8* aa2-230 P[8] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2493 - RNA, 1135 nt, Artificial Sequence
  VP8* aa2-230 P[8]-VirWa SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2494 - RNA, 1126 nt, Artificial Sequence
  VP8* aa2-230 P[4] SP(HSA) mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2495 - RNA, 1126 nt, Artificial Sequence
  VP8* aa2-230 P[6] SP(HSA) mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2496 - RNA, 1126 nt, Artificial Sequence
  R5480/R5481 VP8* aa2-230 P[8] SP(HSA) mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2497 - RNA, 1126 nt, Artificial Sequence
  VP8* aa2-230 P[8]-VirWa SP(HSA) mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2498 - RNA, 1126 nt, Artificial Sequence
  VP8* aa2-230 P[4] SP(IgE) mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2499 - RNA, 1126 nt, Artificial Sequence
  VP8* aa2-230 P[6] SP(IgE) mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2500 - RNA, 1126 nt, Artificial Sequence
  VP8* aa2-230 P[8] SP(IgE) mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2501 - RNA, 1126 nt, Artificial Sequence
  VP8* aa2-230 P[8]-VirWa SP(IgE) mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2502 - RNA, 1144 nt, Artificial Sequence
  VP8* aa2-230 P[4] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2503 - RNA, 1144 nt, Artificial Sequence
  VP8* aa2-230 P[6] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2504 - RNA, 1144 nt, Artificial Sequence
  VP8* aa2-230 P[8] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2505 - RNA, 1144 nt, Artificial Sequence
  VP8* aa2-230 P[8]-VirWa SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2506 - RNA, 1144 nt, Artificial Sequence
  VP8* aa2-230 P[4] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2507 - RNA, 1144 nt, Artificial Sequence
  VP8* aa2-230 P[6] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2508 - RNA, 1144 nt, Artificial Sequence
  VP8* aa2-230 P[8] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2509 - RNA, 1144 nt, Artificial Sequence
  VP8* aa2-230 P[8]-VirWa SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2510 - RNA, 1195 nt, Artificial Sequence
  VP8* aa2-230 P[4] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2511 - RNA, 1195 nt, Artificial Sequence
  VP8* aa2-230 P[6] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2512 - RNA, 1195 nt, Artificial Sequence
  VP8* aa2-230 P[8] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2513 - RNA, 1195 nt, Artificial Sequence
  VP8* aa2-230 P[8]-VirWa SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2514 - RNA, 1186 nt, Artificial Sequence
  VP8* aa2-230 P[4] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2515 - RNA, 1186 nt, Artificial Sequence
  VP8* aa2-230 P[6] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2516 - RNA, 1186 nt, Artificial Sequence
  VP8* aa2-230 P[8] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2517 - RNA, 1186 nt, Artificial Sequence
  VP8* aa2-230 P[8]-VirWa SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2518 - RNA, 1186 nt, Artificial Sequence
  VP8* aa2-230 P[4] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2519 - RNA, 1186 nt, Artificial Sequence
  VP8* aa2-230 P[6] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2520 - RNA, 1186 nt, Artificial Sequence
  VP8* aa2-230 P[8] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2521 - RNA, 1186 nt, Artificial Sequence
  VP8* aa2-230 P[8]-VirWa SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2522 - RNA, 1204 nt, Artificial Sequence
  VP8* aa2-230 P[4] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2523 - RNA, 1204 nt, Artificial Sequence
  VP8* aa2-230 P[6] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2524 - RNA, 1204 nt, Artificial Sequence
  VP8* aa2-230 P[8] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2525 - RNA, 1204 nt, Artificial Sequence
  VP8* aa2-230 P[8]-VirWa SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2526 - RNA, 1204 nt, Artificial Sequence
  VP8* aa2-230 P[4] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2527 - RNA, 1204 nt, Artificial Sequence
  VP8* aa2-230 P[6] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2528 - RNA, 1204 nt, Artificial Sequence
  VP8* aa2-230 P[8] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2529 - RNA, 1204 nt, Artificial Sequence
  VP8* aa2-230 P[8]-VirWa SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2530 - RNA, 1075 nt, Artificial Sequence
  VP8* aa2-230 P[4] w/o glyco mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2531 - RNA, 1075 nt, Artificial Sequence
  VP8* aa2-230 P[6] w/o glyco mRNA opt Design2
ggggcgcugccuacggagguggcagccaucuccuucucggcaucaagcuuaccauggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2532 - RNA, 1075 nt, Artificial Sequence
  VP8* aa2-230 P[8] w/o glyco mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2533 - RNA, 1075 nt, Artificial Sequence
  VP8* aa2-230 P[8]-VirWa w/o glyco mRNA opt Design2
ggggcgcugccuacggagguggcagccaucuccuucucggcaucaagcuuaccauggccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2534 - RNA, 1135 nt, Artificial Sequence
  VP8* aa2-230 P[4] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2535 - RNA, 1135 nt, Artificial Sequence
  VP8* aa2-230 P[6] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2536 - RNA, 1135 nt, Artificial Sequence
  VP8* aa2-230 P[8] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2537 - RNA, 1135 nt, Artificial Sequence
  VP8* aa2-230 P[8]-VirWa P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2538 - RNA, 1135 nt, Artificial Sequence
  VP8* aa2-230 P[4] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2539 - RNA, 1135 nt, Artificial Sequence
  VP8* aa2-230 P[6] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2540 - RNA, 1135 nt, Artificial Sequence
  VP8* aa2-230 P[8] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2541 - RNA, 1135 nt, Artificial Sequence
  VP8* aa2-230 P[8]-VirWa SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2542 - RNA, 1126 nt, Artificial Sequence
  VP8* aa2-230 P[4] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2543 - RNA, 1126 nt, Artificial Sequence
  VP8* aa2-230 P[6] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2544 - RNA, 1126 nt, Artificial Sequence
  VP8* aa2-230 P[8] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2545 - RNA, 1126 nt, Artificial Sequence
  VP8* aa2-230 P[8]-VirWa SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2546 - RNA, 1126 nt, Artificial Sequence
  VP8* aa2-230 P[4] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2547 - RNA, 1126 nt, Artificial Sequence
  VP8* aa2-230 P[6] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2548 - RNA, 1126 nt, Artificial Sequence
  VP8* aa2-230 P[8] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2549 - RNA, 1126 nt, Artificial Sequence
  VP8* aa2-230 P[8]-VirWa SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2550 - RNA, 1144 nt, Artificial Sequence
  VP8* aa2-230 P[4] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2551 - RNA, 1144 nt, Artificial Sequence
  VP8* aa2-230 P[6] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2552 - RNA, 1144 nt, Artificial Sequence
  VP8* aa2-230 P[8] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2553 - RNA, 1144 nt, Artificial Sequence
  VP8* aa2-230 P[8]-VirWa SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2554 - RNA, 1144 nt, Artificial Sequence
  VP8* aa2-230 P[4] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2555 - RNA, 1144 nt, Artificial Sequence
  VP8* aa2-230 P[6] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2556 - RNA, 1144 nt, Artificial Sequence
  VP8* aa2-230 P[8] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2557 - RNA, 1144 nt, Artificial Sequence
  VP8* aa2-230 P[8]-VirWa SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2558 - RNA, 1195 nt, Artificial Sequence
  VP8* aa2-230 P[4] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2559 - RNA, 1195 nt, Artificial Sequence
  VP8* aa2-230 P[6] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2560 - RNA, 1195 nt, Artificial Sequence
  VP8* aa2-230 P[8] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2561 - RNA, 1195 nt, Artificial Sequence
  VP8* aa2-230 P[8]-VirWa SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2562 - RNA, 1186 nt, Artificial Sequence
  VP8* aa2-230 P[4] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2563 - RNA, 1186 nt, Artificial Sequence
  VP8* aa2-230 P[6] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2564 - RNA, 1186 nt, Artificial Sequence
  VP8* aa2-230 P[8] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2565 - RNA, 1186 nt, Artificial Sequence
  VP8* aa2-230 P[8]-VirWa SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2566 - RNA, 1186 nt, Artificial Sequence
  VP8* aa2-230 P[4] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2567 - RNA, 1186 nt, Artificial Sequence
  VP8* aa2-230 P[6] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2568 - RNA, 1186 nt, Artificial Sequence
  VP8* aa2-230 P[8] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2569 - RNA, 1186 nt, Artificial Sequence
  VP8* aa2-230 P[8]-VirWa SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2570 - RNA, 1204 nt, Artificial Sequence
  VP8* aa2-230 P[4] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2571 - RNA, 1204 nt, Artificial Sequence
  VP8* aa2-230 P[6] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2572 - RNA, 1204 nt, Artificial Sequence
  VP8* aa2-230 P[8] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2573 - RNA, 1204 nt, Artificial Sequence
  VP8* aa2-230 P[8]-VirWa SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2574 - RNA, 1204 nt, Artificial Sequence
  VP8* aa2-230 P[4] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2575 - RNA, 1204 nt, Artificial Sequence
  VP8* aa2-230 P[6] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2576 - RNA, 1204 nt, Artificial Sequence
  VP8* aa2-230 P[8] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2577 - RNA, 1204 nt, Artificial Sequence
  VP8* aa2-230 P[8]-VirWa SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2578 - RNA, 1027 nt, Artificial Sequence
  VP8* aa11-223 P[4] mRNA opt Design2
ggggcgcugccuacggagguggcagccaucuccuucucggcaucaagcuuaccaugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2579 - RNA, 1027 nt, Artificial Sequence
  VP8* aa11-223 P[6] mRNA opt Design2
ggggcgcugccuacggagguggcagccaucuccuucucggcaucaagcuuaccaugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2580 - RNA, 1027 nt, Artificial Sequence
  VP8* aa11-223 P[8] mRNA opt Design2
ggggcgcugccuacggagguggcagccaucuccuucucggcaucaagcuuaccaugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2581 - RNA, 1027 nt, Artificial Sequence
  VP8* aa11-223 P[8]-VirWa mRNA opt Design2
ggggcgcugccuacggagguggcagccaucuccuucucggcaucaagcuuaccaugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2582 - RNA, 1087 nt, Artificial Sequence
  VP8* aa11-223 P[4] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2583 - RNA, 1087 nt, Artificial Sequence
  VP8* aa11-223 P[6] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2584 - RNA, 1087 nt, Artificial Sequence
  VP8* aa11-223 P[8] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2585 - RNA, 1087 nt, Artificial Sequence
  VP8* aa11-223 P[8]-VirWa P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2586 - RNA, 1087 nt, Artificial Sequence
  VP8* aa11-223 P[4] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2587 - RNA, 1087 nt, Artificial Sequence
  VP8* aa11-223 P[6] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2588 - RNA, 1087 nt, Artificial Sequence
  VP8* aa11-223 P[8] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2589 - RNA, 1087 nt, Artificial Sequence
  VP8* aa11-223 P[8]-VirWa SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2590 - RNA, 1078 nt, Artificial Sequence
  VP8* aa11-223 P[4] SP(HSA) mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2591 - RNA, 1078 nt, Artificial Sequence
  VP8* aa11-223 P[6] SP(HSA) mRNA opt Design2
ggggcgcugccuacggagguggcagccaucuccuucucggcaucaagcuuaccaugaagugggugaccuucaucagccugcucuuccuguucuccagcgccuacuccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2592 - RNA, 1078 nt, Artificial Sequence
  R5482/R5483 VP8* aa11-223 P[8] SP(HSA) mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2593 - RNA, 1078 nt, Artificial Sequence
  VP8* aa11-223 P[8]-VirWa SP(HSA) mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2594 - RNA, 1078 nt, Artificial Sequence
  VP8* aa11-223 P[4] SP(IgE) mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2595 - RNA, 1078 nt, Artificial Sequence
  VP8* aa11-223 P[6] SP(IgE) mRNA opt Design2
ggggcgcugccuacggagguggcagccaucuccuucucggcaucaagcuuaccauggacuggaccuggauccuguuccucguggccgccgcgacccgcguccacagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2596 - RNA, 1078 nt, Artificial Sequence
  VP8* aa11-223 P[8] SP(IgE) mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2597 - RNA, 1078 nt, Artificial Sequence
  VP8* aa11-223 P[8]-VirWa SP(IgE) mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2598 - RNA, 1096 nt, Artificial Sequence
  VP8* aa11-223 P[4] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2599 - RNA, 1096 nt, Artificial Sequence
  VP8* aa11-223 P[6] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2600 - RNA, 1096 nt, Artificial Sequence
  VP8* aa11-223 P[8] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2601 - RNA, 1096 nt, Artificial Sequence
  VP8* aa11-223 P[8]-VirWa SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2602 - RNA, 1096 nt, Artificial Sequence
  VP8* aa11-223 P[4] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2603 - RNA, 1096 nt, Artificial Sequence
  VP8* aa11-223 P[6] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2604 - RNA, 1096 nt, Artificial Sequence
  VP8* aa11-223 P[8] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2605 - RNA, 1096 nt, Artificial Sequence
  VP8* aa11-223 P[8]-VirWa SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2606 - RNA, 1147 nt, Artificial Sequence
  VP8* aa11-223 P[4] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2607 - RNA, 1147 nt, Artificial Sequence
  VP8* aa11-223 P[6] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2608 - RNA, 1147 nt, Artificial Sequence
  VP8* aa11-223 P[8] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2609 - RNA, 1147 nt, Artificial Sequence
  VP8* aa11-223 P[8]-VirWa SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2610 - RNA, 1138 nt, Artificial Sequence
  VP8* aa11-223 P[4] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2611 - RNA, 1138 nt, Artificial Sequence
  VP8* aa11-223 P[6] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2612 - RNA, 1138 nt, Artificial Sequence
  VP8* aa11-223 P[8] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2613 - RNA, 1138 nt, Artificial Sequence
  VP8* aa11-223 P[8]-VirWa SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2614 - RNA, 1138 nt, Artificial Sequence
  VP8* aa11-223 P[4] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2615 - RNA, 1138 nt, Artificial Sequence
  VP8* aa11-223 P[6] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2616 - RNA, 1138 nt, Artificial Sequence
  VP8* aa11-223 P[8] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2617 - RNA, 1138 nt, Artificial Sequence
  VP8* aa11-223 P[8]-VirWa SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2618 - RNA, 1156 nt, Artificial Sequence
  VP8* aa11-223 P[4] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2619 - RNA, 1156 nt, Artificial Sequence
  VP8* aa11-223 P[6] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2620 - RNA, 1156 nt, Artificial Sequence
  VP8* aa11-223 P[8] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2621 - RNA, 1156 nt, Artificial Sequence
  VP8* aa11-223 P[8]-VirWa SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2622 - RNA, 1156 nt, Artificial Sequence
  VP8* aa11-223 P[4] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2623 - RNA, 1156 nt, Artificial Sequence
  VP8* aa11-223 P[6] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2624 - RNA, 1156 nt, Artificial Sequence
  VP8* aa11-223 P[8] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2625 - RNA, 1156 nt, Artificial Sequence
  VP8* aa11-223 P[8]-VirWa SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2626 - RNA, 1027 nt, Artificial Sequence
  VP8* aa11-223 P[4] w/o glyco mRNA opt Design2
ggggcgcugccuacggagguggcagccaucuccuucucggcaucaagcuuaccaugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2627 - RNA, 1027 nt, Artificial Sequence
  VP8* aa11-223 P[6] w/o glyco mRNA opt Design2
ggggcgcugccuacggagguggcagccaucuccuucucggcaucaagcuuaccaugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2628 - RNA, 1027 nt, Artificial Sequence
  VP8* aa11-223 P[8] w/o glyco mRNA opt Design2
ggggcgcugccuacggagguggcagccaucuccuucucggcaucaagcuuaccaugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2629 - RNA, 1027 nt, Artificial Sequence
  VP8* aa11-223 P[8]-VirWa w/o glyco mRNA opt Design2
ggggcgcugccuacggagguggcagccaucuccuucucggcaucaagcuuaccaugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2630 - RNA, 1087 nt, Artificial Sequence
  VP8* aa11-223 P[4] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2631 - RNA, 1087 nt, Artificial Sequence
  VP8* aa11-223 P[6] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2632 - RNA, 1087 nt, Artificial Sequence
  VP8* aa11-223 P[8] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2633 - RNA, 1087 nt, Artificial Sequence
  VP8* aa11-223 P[8]-VirWa P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2634 - RNA, 1087 nt, Artificial Sequence
  VP8* aa11-223 P[4] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2635 - RNA, 1087 nt, Artificial Sequence
  VP8* aa11-223 P[6] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2636 - RNA, 1087 nt, Artificial Sequence
  VP8* aa11-223 P[8] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2637 - RNA, 1087 nt, Artificial Sequence
  VP8* aa11-223 P[8]-VirWa SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2638 - RNA, 1078 nt, Artificial Sequence
  VP8* aa11-223 P[4] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2639 - RNA, 1078 nt, Artificial Sequence
  VP8* aa11-223 P[6] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2640 - RNA, 1078 nt, Artificial Sequence
  VP8* aa11-223 P[8] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2641 - RNA, 1078 nt, Artificial Sequence
  VP8* aa11-223 P[8]-VirWa SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2642 - RNA, 1078 nt, Artificial Sequence
  VP8* aa11-223 P[4] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2643 - RNA, 1078 nt, Artificial Sequence
  VP8* aa11-223 P[6] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2644 - RNA, 1078 nt, Artificial Sequence
  VP8* aa11-223 P[8] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2645 - RNA, 1078 nt, Artificial Sequence
  VP8* aa11-223 P[8]-VirWa SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2646 - RNA, 1096 nt, Artificial Sequence
  VP8* aa11-223 P[4] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2647 - RNA, 1096 nt, Artificial Sequence
  VP8* aa11-223 P[6] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2648 - RNA, 1096 nt, Artificial Sequence
  VP8* aa11-223 P[8] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2649 - RNA, 1096 nt, Artificial Sequence
  VP8* aa11-223 P[8]-VirWa SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2650 - RNA, 1096 nt, Artificial Sequence
  VP8* aa11-223 P[4] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2651 - RNA, 1096 nt, Artificial Sequence
  VP8* aa11-223 P[6] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2652 - RNA, 1096 nt, Artificial Sequence
  VP8* aa11-223 P[8] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2653 - RNA, 1096 nt, Artificial Sequence
  VP8* aa11-223 P[8]-VirWa SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2654 - RNA, 1147 nt, Artificial Sequence
  VP8* aa11-223 P[4] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2655 - RNA, 1147 nt, Artificial Sequence
  VP8* aa11-223 P[6] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2656 - RNA, 1147 nt, Artificial Sequence
  VP8* aa11-223 P[8] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2657 - RNA, 1147 nt, Artificial Sequence
  VP8* aa11-223 P[8]-VirWa SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2658 - RNA, 1138 nt, Artificial Sequence
  VP8* aa11-223 P[4] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2659 - RNA, 1138 nt, Artificial Sequence
  VP8* aa11-223 P[6] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2660 - RNA, 1138 nt, Artificial Sequence
  VP8* aa11-223 P[8] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2661 - RNA, 1138 nt, Artificial Sequence
  VP8* aa11-223 P[8]-VirWa SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2662 - RNA, 1138 nt, Artificial Sequence
  VP8* aa11-223 P[4] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2663 - RNA, 1138 nt, Artificial Sequence
  VP8* aa11-223 P[6] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2664 - RNA, 1138 nt, Artificial Sequence
  VP8* aa11-223 P[8] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2665 - RNA, 1138 nt, Artificial Sequence
  VP8* aa11-223 P[8]-VirWa SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2666 - RNA, 1156 nt, Artificial Sequence
  VP8* aa11-223 P[4] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2667 - RNA, 1156 nt, Artificial Sequence
  VP8* aa11-223 P[6] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2668 - RNA, 1156 nt, Artificial Sequence
  VP8* aa11-223 P[8] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2669 - RNA, 1156 nt, Artificial Sequence
  VP8* aa11-223 P[8]-VirWa SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2670 - RNA, 1156 nt, Artificial Sequence
  VP8* aa11-223 P[4] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2671 - RNA, 1156 nt, Artificial Sequence
  VP8* aa11-223 P[6] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2672 - RNA, 1156 nt, Artificial Sequence
  VP8* aa11-223 P[8] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2673 - RNA, 1156 nt, Artificial Sequence
  VP8* aa11-223 P[8]-VirWa SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2674 - RNA, 1078 nt, Artificial Sequence
  VP8* aa11-240 P[4] mRNA opt Design2
ggggcgcugccuacggagguggcagccaucuccuucucggcaucaagcuuaccaugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2675 - RNA, 1078 nt, Artificial Sequence
  VP8* aa11-240 P[6] mRNA opt Design2
ggggcgcugccuacggagguggcagccaucuccuucucggcaucaagcuuaccaugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2676 - RNA, 1078 nt, Artificial Sequence
  VP8* aa11-240 P[8] mRNA opt Design2
ggggcgcugccuacggagguggcagccaucuccuucucggcaucaagcuuaccaugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2677 - RNA, 1078 nt, Artificial Sequence
  VP8* aa11-240 P[8]-VirWa mRNA opt Design2
ggggcgcugccuacggagguggcagccaucuccuucucggcaucaagcuuaccaugaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2678 - RNA, 1138 nt, Artificial Sequence
  VP8* aa11-240 P[4] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2679 - RNA, 1138 nt, Artificial Sequence
  VP8* aa11-240 P[6] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2680 - RNA, 1138 nt, Artificial Sequence
  VP8* aa11-240 P[8] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2681 - RNA, 1138 nt, Artificial Sequence
  VP8* aa11-240 P[8]-VirWa P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2682 - RNA, 1138 nt, Artificial Sequence
  VP8* aa11-240 P[4] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2683 - RNA, 1138 nt, Artificial Sequence
  VP8* aa11-240 P[6] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2684 - RNA, 1138 nt, Artificial Sequence
  VP8* aa11-240 P[8] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2685 - RNA, 1138 nt, Artificial Sequence
  VP8* aa11-240 P[8]-VirWa SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2686 - RNA, 1129 nt, Artificial Sequence
  VP8* aa11-240 P[4] SP(HSA) mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2687 - RNA, 1129 nt, Artificial Sequence
  VP8* aa11-240 P[6] SP(HSA) mRNA opt Design2
ggggcgcugccuacggagguggcagccaucuccuucucggcaucaagcuuaccaugaagugggugaccuucaucagccugcucuuccuguucuccagcgccuacuccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2688 - RNA, 1129 nt, Artificial Sequence
  VP8* aa11-240 P[8] SP(HSA) mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2689 - RNA, 1129 nt, Artificial Sequence
  VP8* aa11-240 P[8]-VirWa SP(HSA) mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2690 - RNA, 1129 nt, Artificial Sequence
  VP8* aa11-240 P[4] SP(IgE) mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2691 - RNA, 1129 nt, Artificial Sequence
  VP8* aa11-240 P[6] SP(IgE) mRNA opt Design2
ggggcgcugccuacggagguggcagccaucuccuucucggcaucaagcuuaccauggacuggaccuggauccuguuccucguggccgccgcgacccgcguccacagcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2692 - RNA, 1129 nt, Artificial Sequence
  VP8* aa11-240 P[8] SP(IgE) mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2693 - RNA, 1129 nt, Artificial Sequence
  VP8* aa11-240 P[8]-VirWa SP(IgE) mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2694 - RNA, 1147 nt, Artificial Sequence
  VP8* aa11-240 P[4] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2695 - RNA, 1147 nt, Artificial Sequence
  VP8* aa11-240 P[6] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2696 - RNA, 1147 nt, Artificial Sequence
  VP8* aa11-240 P[8] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2697 - RNA, 1147 nt, Artificial Sequence
  VP8* aa11-240 P[8]-VirWa SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2698 - RNA, 1147 nt, Artificial Sequence
  VP8* aa11-240 P[4] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2699 - RNA, 1147 nt, Artificial Sequence
  VP8* aa11-240 P[6] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2700 - RNA, 1147 nt, Artificial Sequence
  VP8* aa11-240 P[8] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2701 - RNA, 1147 nt, Artificial Sequence
  VP8* aa11-240 P[8]-VirWa SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2702 - RNA, 1198 nt, Artificial Sequence
  VP8* aa11-240 P[4] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2703 - RNA, 1198 nt, Artificial Sequence
  VP8* aa11-240 P[6] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2704 - RNA, 1198 nt, Artificial Sequence
  VP8* aa11-240 P[8] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2705 - RNA, 1198 nt, Artificial Sequence
  VP8* aa11-240 P[8]-VirWa SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2706 - RNA, 1189 nt, Artificial Sequence
  VP8* aa11-240 P[4] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2707 - RNA, 1189 nt, Artificial Sequence
  VP8* aa11-240 P[6] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2708 - RNA, 1189 nt, Artificial Sequence
  VP8* aa11-240 P[8] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2709 - RNA, 1189 nt, Artificial Sequence
  VP8* aa11-240 P[8]-VirWa SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2710 - RNA, 1189 nt, Artificial Sequence
  VP8* aa11-240 P[4] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2711 - RNA, 1189 nt, Artificial Sequence
  VP8* aa11-240 P[6] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2712 - RNA, 1189 nt, Artificial Sequence
  VP8* aa11-240 P[8] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2713 - RNA, 1189 nt, Artificial Sequence
  VP8* aa11-240 P[8]-VirWa SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2714 - RNA, 1207 nt, Artificial Sequence
  VP8* aa11-240 P[4] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2715 - RNA, 1207 nt, Artificial Sequence
  VP8* aa11-240 P[6] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2716 - RNA, 1207 nt, Artificial Sequence
  VP8* aa11-240 P[8] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2717 - RNA, 1207 nt, Artificial Sequence
  VP8* aa11-240 P[8]-VirWa SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2718 - RNA, 1207 nt, Artificial Sequence
  VP8* aa11-240 P[4] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2719 - RNA, 1207 nt, Artificial Sequence
  VP8* aa11-240 P[6] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2720 - RNA, 1207 nt, Artificial Sequence
  VP8* aa11-240 P[8] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2721 - RNA, 1207 nt, Artificial Sequence
  VP8* aa11-240 P[8]-VirWa SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2722 - RNA, 1078 nt, Artificial Sequence
  VP8* aa11-240 P[4] w/o glyco mRNA opt Design2
ggggcgcugccuacggagguggcagccaucuccuucucggcaucaagcuuaccaugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2723 - RNA, 1078 nt, Artificial Sequence
  VP8* aa11-240 P[6] w/o glyco mRNA opt Design2
ggggcgcugccuacggagguggcagccaucuccuucucggcaucaagcuuaccaugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2724 - RNA, 1078 nt, Artificial Sequence
  VP8* aa11-240 P[8] w/o glyco mRNA opt Design2
ggggcgcugccuacggagguggcagccaucuccuucucggcaucaagcuuaccaugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2725 - RNA, 1078 nt, Artificial Sequence
  VP8* aa11-240 P[8]-VirWa w/o glyco mRNA opt Design2
ggggcgcugccuacggagguggcagccaucuccuucucggcaucaagcuuaccaugaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2726 - RNA, 1138 nt, Artificial Sequence
  VP8* aa11-240 P[4] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2727 - RNA, 1138 nt, Artificial Sequence
  VP8* aa11-240 P[6] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2728 - RNA, 1138 nt, Artificial Sequence
  VP8* aa11-240 P[8] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2729 - RNA, 1138 nt, Artificial Sequence
  VP8* aa11-240 P[8]-VirWa P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2730 - RNA, 1138 nt, Artificial Sequence
  VP8* aa11-240 P[4] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2731 - RNA, 1138 nt, Artificial Sequence
  VP8* aa11-240 P[6] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2732 - RNA, 1138 nt, Artificial Sequence
  VP8* aa11-240 P[8] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2733 - RNA, 1138 nt, Artificial Sequence
  VP8* aa11-240 P[8]-VirWa SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2734 - RNA, 1129 nt, Artificial Sequence
  VP8* aa11-240 P[4] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2735 - RNA, 1129 nt, Artificial Sequence
  VP8* aa11-240 P[6] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2736 - RNA, 1129 nt, Artificial Sequence
  R5490/R5491 VP8* aa11-240 P[8] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2737 - RNA, 1129 nt, Artificial Sequence
  VP8* aa11-240 P[8]-VirWa SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2738 - RNA, 1129 nt, Artificial Sequence
  VP8* aa11-240 P[4] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2739 - RNA, 1129 nt, Artificial Sequence
  VP8* aa11-240 P[6] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2740 - RNA, 1129 nt, Artificial Sequence
  VP8* aa11-240 P[8] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2741 - RNA, 1129 nt, Artificial Sequence
  VP8* aa11-240 P[8]-VirWa SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2742 - RNA, 1147 nt, Artificial Sequence
  VP8* aa11-240 P[4] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2743 - RNA, 1147 nt, Artificial Sequence
  VP8* aa11-240 P[6] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2744 - RNA, 1147 nt, Artificial Sequence
  VP8* aa11-240 P[8] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2745 - RNA, 1147 nt, Artificial Sequence
  VP8* aa11-240 P[8]-VirWa SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2746 - RNA, 1147 nt, Artificial Sequence
  VP8* aa11-240 P[4] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2747 - RNA, 1147 nt, Artificial Sequence
  VP8* aa11-240 P[6] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2748 - RNA, 1147 nt, Artificial Sequence
  VP8* aa11-240 P[8] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2749 - RNA, 1147 nt, Artificial Sequence
  VP8* aa11-240 P[8]-VirWa SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2750 - RNA, 1198 nt, Artificial Sequence
  VP8* aa11-240 P[4] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2751 - RNA, 1198 nt, Artificial Sequence
  VP8* aa11-240 P[6] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2752 - RNA, 1198 nt, Artificial Sequence
  VP8* aa11-240 P[8] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2753 - RNA, 1198 nt, Artificial Sequence
  VP8* aa11-240 P[8]-VirWa SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2754 - RNA, 1189 nt, Artificial Sequence
  VP8* aa11-240 P[4] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2755 - RNA, 1189 nt, Artificial Sequence
  VP8* aa11-240 P[6] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2756 - RNA, 1189 nt, Artificial Sequence
  VP8* aa11-240 P[8] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2757 - RNA, 1189 nt, Artificial Sequence
  VP8* aa11-240 P[8]-VirWa SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2758 - RNA, 1189 nt, Artificial Sequence
  VP8* aa11-240 P[4] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2759 - RNA, 1189 nt, Artificial Sequence
  VP8* aa11-240 P[6] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2760 - RNA, 1189 nt, Artificial Sequence
  VP8* aa11-240 P[8] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2761 - RNA, 1189 nt, Artificial Sequence
  VP8* aa11-240 P[8]-VirWa SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2762 - RNA, 1207 nt, Artificial Sequence
  VP8* aa11-240 P[4] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2763 - RNA, 1207 nt, Artificial Sequence
  VP8* aa11-240 P[6] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2764 - RNA, 1207 nt, Artificial Sequence
  VP8* aa11-240 P[8] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2765 - RNA, 1207 nt, Artificial Sequence
  VP8* aa11-240 P[8]-VirWa SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2766 - RNA, 1207 nt, Artificial Sequence
  VP8* aa11-240 P[4] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2767 - RNA, 1207 nt, Artificial Sequence
  VP8* aa11-240 P[6] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2768 - RNA, 1207 nt, Artificial Sequence
  VP8* aa11-240 P[8] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2769 - RNA, 1207 nt, Artificial Sequence
  VP8* aa11-240 P[8]-VirWa SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacagcguggaccugcacgacgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2770 - RNA, 1048 nt, Artificial Sequence
  VP8* aa21-240 P[4] mRNA opt Design2
ggggcgcugccuacggagguggcagccaucuccuucucggcaucaagcuuaccauggagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2771 - RNA, 1048 nt, Artificial Sequence
  VP8* aa21-240 P[6] mRNA opt Design2
ggggcgcugccuacggagguggcagccaucuccuucucggcaucaagcuuaccauggagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2772 - RNA, 1048 nt, Artificial Sequence
  VP8* aa21-240 P[8] mRNA opt Design2
ggggcgcugccuacggagguggcagccaucuccuucucggcaucaagcuuaccauggagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2773 - RNA, 1048 nt, Artificial Sequence
  VP8* aa21-240 P[8]-VirWa mRNA opt Design2
ggggcgcugccuacggagguggcagccaucuccuucucggcaucaagcuuaccauggagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2774 - RNA, 1108 nt, Artificial Sequence
  VP8* aa21-240 P[4] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2775 - RNA, 1108 nt, Artificial Sequence
  VP8* aa21-240 P[6] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2776 - RNA, 1108 nt, Artificial Sequence
  VP8* aa21-240 P[8] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2777 - RNA, 1108 nt, Artificial Sequence
  VP8* aa21-240 P[8]-VirWa P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2778 - RNA, 1108 nt, Artificial Sequence
  VP8* aa21-240 P[4] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2779 - RNA, 1108 nt, Artificial Sequence
  VP8* aa21-240 P[6] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2780 - RNA, 1108 nt, Artificial Sequence
  VP8* aa21-240 P[8] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2781 - RNA, 1108 nt, Artificial Sequence
  VP8* aa21-240 P[8]-VirWa SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2782 - RNA, 1099 nt, Artificial Sequence
  VP8* aa21-240 P[4] SP(HSA) mRNA opt Design2
ggggcgcugccuacggagguggcagccaucuccuucucggcaucaagcuuaccaugaagugggugaccuucaucagccugcucuuccuguucuccagcgccuacuccgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2783 - RNA, 1099 nt, Artificial Sequence
  VP8* aa21-240 P[6] SP(HSA) mRNA opt Design2
ggggcgcugccuacggagguggcagccaucuccuucucggcaucaagcuuaccaugaagugggugaccuucaucagccugcucuuccuguucuccagcgccuacuccgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2784 - RNA, 1099 nt, Artificial Sequence
  VP8* aa21-240 P[8] SP(HSA) mRNA opt Design2
ggggcgcugccuacggagguggcagccaucuccuucucggcaucaagcuuaccaugaagugggugaccuucaucagccugcucuuccuguucuccagcgccuacuccgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2785 - RNA, 1099 nt, Artificial Sequence
  VP8* aa21-240 P[8]-VirWa SP(HSA) mRNA opt Design2
ggggcgcugccuacggagguggcagccaucuccuucucggcaucaagcuuaccaugaagugggugaccuucaucagccugcucuuccuguucuccagcgccuacuccgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2786 - RNA, 1099 nt, Artificial Sequence
  VP8* aa21-240 P[4] SP(IgE) mRNA opt Design2
ggggcgcugccuacggagguggcagccaucuccuucucggcaucaagcuuaccauggacuggaccuggauccuguuccucguggccgccgcgacccgcguccacagcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2787 - RNA, 1099 nt, Artificial Sequence
  VP8* aa21-240 P[6] SP(IgE) mRNA opt Design2
ggggcgcugccuacggagguggcagccaucuccuucucggcaucaagcuuaccauggacuggaccuggauccuguuccucguggccgccgcgacccgcguccacagcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2788 - RNA, 1099 nt, Artificial Sequence
  VP8* aa21-240 P[8] SP(IgE) mRNA opt Design2
ggggcgcugccuacggagguggcagccaucuccuucucggcaucaagcuuaccauggacuggaccuggauccuguuccucguggccgccgcgacccgcguccacagcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2789 - RNA, 1099 nt, Artificial Sequence
  VP8* aa21-240 P[8]-VirWa SP(IgE) mRNA opt Design2
ggggcgcugccuacggagguggcagccaucuccuucucggcaucaagcuuaccauggacuggaccuggauccuguuccucguggccgccgcgacccgcguccacagcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2790 - RNA, 1117 nt, Artificial Sequence
  VP8* aa21-240 P[4] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2791 - RNA, 1117 nt, Artificial Sequence
  VP8* aa21-240 P[6] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2792 - RNA, 1117 nt, Artificial Sequence
  VP8* aa21-240 P[8] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2793 - RNA, 1117 nt, Artificial Sequence
  VP8* aa21-240 P[8]-VirWa SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2794 - RNA, 1117 nt, Artificial Sequence
  VP8* aa21-240 P[4] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2795 - RNA, 1117 nt, Artificial Sequence
  VP8* aa21-240 P[6] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2796 - RNA, 1117 nt, Artificial Sequence
  VP8* aa21-240 P[8] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2797 - RNA, 1117 nt, Artificial Sequence
  VP8* aa21-240 P[8]-VirWa SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2798 - RNA, 1168 nt, Artificial Sequence
  VP8* aa21-240 P[4] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2799 - RNA, 1168 nt, Artificial Sequence
  VP8* aa21-240 P[6] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2800 - RNA, 1168 nt, Artificial Sequence
  VP8* aa21-240 P[8] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2801 - RNA, 1168 nt, Artificial Sequence
  VP8* aa21-240 P[8]-VirWa SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2802 - RNA, 1159 nt, Artificial Sequence
  VP8* aa21-240 P[4] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2803 - RNA, 1159 nt, Artificial Sequence
  VP8* aa21-240 P[6] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2804 - RNA, 1159 nt, Artificial Sequence
  VP8* aa21-240 P[8] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2805 - RNA, 1159 nt, Artificial Sequence
  VP8* aa21-240 P[8]-VirWa SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2806 - RNA, 1159 nt, Artificial Sequence
  VP8* aa21-240 P[4] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2807 - RNA, 1159 nt, Artificial Sequence
  VP8* aa21-240 P[6] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2808 - RNA, 1159 nt, Artificial Sequence
  VP8* aa21-240 P[8] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2809 - RNA, 1159 nt, Artificial Sequence
  VP8* aa21-240 P[8]-VirWa SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2810 - RNA, 1177 nt, Artificial Sequence
  VP8* aa21-240 P[4] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2811 - RNA, 1177 nt, Artificial Sequence
  VP8* aa21-240 P[6] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2812 - RNA, 1177 nt, Artificial Sequence
  VP8* aa21-240 P[8] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2813 - RNA, 1177 nt, Artificial Sequence
  VP8* aa21-240 P[8]-VirWa SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2814 - RNA, 1177 nt, Artificial Sequence
  VP8* aa21-240 P[4] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2815 - RNA, 1177 nt, Artificial Sequence
  VP8* aa21-240 P[6] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2816 - RNA, 1177 nt, Artificial Sequence
  VP8* aa21-240 P[8] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2817 - RNA, 1177 nt, Artificial Sequence
  VP8* aa21-240 P[8]-VirWa SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagaacgucacgaucaaccccagccccuucgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugcccccgauccagaacacgcggaacgucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2818 - RNA, 1048 nt, Artificial Sequence
  VP8* aa21-240 P[4] w/o glyco mRNA opt Design2
ggggcgcugccuacggagguggcagccaucuccuucucggcaucaagcuuaccauggagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2819 - RNA, 1048 nt, Artificial Sequence
  VP8* aa21-240 P[6] w/o glyco mRNA opt Design2
ggggcgcugccuacggagguggcagccaucuccuucucggcaucaagcuuaccauggagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2820 - RNA, 1048 nt, Artificial Sequence
  VP8* aa21-240 P[8] w/o glyco mRNA opt Design2
ggggcgcugccuacggagguggcagccaucuccuucucggcaucaagcuuaccauggagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2821 - RNA, 1048 nt, Artificial Sequence
  VP8* aa21-240 P[8]-VirWa w/o glyco mRNA opt Design2
ggggcgcugccuacggagguggcagccaucuccuucucggcaucaagcuuaccauggagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2822 - RNA, 1108 nt, Artificial Sequence
  VP8* aa21-240 P[4] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2823 - RNA, 1108 nt, Artificial Sequence
  VP8* aa21-240 P[6] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2824 - RNA, 1108 nt, Artificial Sequence
  VP8* aa21-240 P[8] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2825 - RNA, 1108 nt, Artificial Sequence
  VP8* aa21-240 P[8]-VirWa P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2826 - RNA, 1108 nt, Artificial Sequence
  VP8* aa21-240 P[4] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2827 - RNA, 1108 nt, Artificial Sequence
  R5436/R5597 VP8* aa21-240 P[6] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2828 - RNA, 1108 nt, Artificial Sequence
  VP8* aa21-240 P[8] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2829 - RNA, 1108 nt, Artificial Sequence
  VP8* aa21-240 P[8]-VirWa SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2830 - RNA, 1099 nt, Artificial Sequence
  VP8* aa21-240 P[4] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2831 - RNA, 1099 nt, Artificial Sequence
  VP8* aa21-240 P[6] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2832 - RNA, 1099 nt, Artificial Sequence
  VP8* aa21-240 P[8] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2833 - RNA, 1099 nt, Artificial Sequence
  VP8* aa21-240 P[8]-VirWa SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2834 - RNA, 1099 nt, Artificial Sequence
  VP8* aa21-240 P[4] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2835 - RNA, 1099 nt, Artificial Sequence
  VP8* aa21-240 P[6] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2836 - RNA, 1099 nt, Artificial Sequence
  VP8* aa21-240 P[8] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2837 - RNA, 1099 nt, Artificial Sequence
  VP8* aa21-240 P[8]-VirWa SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2838 - RNA, 1117 nt, Artificial Sequence
  VP8* aa21-240 P[4] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2839 - RNA, 1117 nt, Artificial Sequence
  VP8* aa21-240 P[6] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2840 - RNA, 1117 nt, Artificial Sequence
  VP8* aa21-240 P[8] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2841 - RNA, 1117 nt, Artificial Sequence
  VP8* aa21-240 P[8]-VirWa SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2842 - RNA, 1117 nt, Artificial Sequence
  VP8* aa21-240 P[4] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2843 - RNA, 1117 nt, Artificial Sequence
  VP8* aa21-240 P[6] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2844 - RNA, 1117 nt, Artificial Sequence
  VP8* aa21-240 P[8] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2845 - RNA, 1117 nt, Artificial Sequence
  VP8* aa21-240 P[8]-VirWa SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2846 - RNA, 1168 nt, Artificial Sequence
  VP8* aa21-240 P[4] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2847 - RNA, 1168 nt, Artificial Sequence
  VP8* aa21-240 P[6] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2848 - RNA, 1168 nt, Artificial Sequence
  VP8* aa21-240 P[8] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2849 - RNA, 1168 nt, Artificial Sequence
  VP8* aa21-240 P[8]-VirWa SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2850 - RNA, 1159 nt, Artificial Sequence
  VP8* aa21-240 P[4] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2851 - RNA, 1159 nt, Artificial Sequence
  VP8* aa21-240 P[6] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2852 - RNA, 1159 nt, Artificial Sequence
  VP8* aa21-240 P[8] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2853 - RNA, 1159 nt, Artificial Sequence
  VP8* aa21-240 P[8]-VirWa SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2854 - RNA, 1159 nt, Artificial Sequence
  VP8* aa21-240 P[4] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2855 - RNA, 1159 nt, Artificial Sequence
  VP8* aa21-240 P[6] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2856 - RNA, 1159 nt, Artificial Sequence
  VP8* aa21-240 P[8] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2857 - RNA, 1159 nt, Artificial Sequence
  VP8* aa21-240 P[8]-VirWa SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2858 - RNA, 1177 nt, Artificial Sequence
  VP8* aa21-240 P[4] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2859 - RNA, 1177 nt, Artificial Sequence
  VP8* aa21-240 P[6] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2860 - RNA, 1177 nt, Artificial Sequence
  VP8* aa21-240 P[8] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2861 - RNA, 1177 nt, Artificial Sequence
  VP8* aa21-240 P[8]-VirWa SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2862 - RNA, 1177 nt, Artificial Sequence
  VP8* aa21-240 P[4] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugccgcccauccagaacacccggcagguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2863 - RNA, 1177 nt, Artificial Sequence
  VP8* aa21-240 P[6] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2864 - RNA, 1177 nt, Artificial Sequence
  VP8* aa21-240 P[8] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugcccccgauccagaacacccggcagguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2865 - RNA, 1177 nt, Artificial Sequence
  VP8* aa21-240 P[8]-VirWa SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucgagcagaucggcuccgagaagacccagcaggucacgaucaaccccagccccuucgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugcccccgauccagaacacgcggcaggucgugccccugccccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2866 - RNA, 937 nt, Artificial Sequence
  VP8* aa41-223P[4] mRNA opt Design2
ggggcgcugccuacggagguggcagccaucuccuucucggcaucaagcuuaccauggcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2867 - RNA, 937 nt, Artificial Sequence
  VP8* aa41-223P[6] mRNA opt Design2
ggggcgcugccuacggagguggcagccaucuccuucucggcaucaagcuuaccauggcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2868 - RNA, 937 nt, Artificial Sequence
  VP8* aa41-223P[8] mRNA opt Design2
ggggcgcugccuacggagguggcagccaucuccuucucggcaucaagcuuaccauggcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2869 - RNA, 937 nt, Artificial Sequence
  VP8* aa41-223P[8]-VirWa mRNA opt Design2
ggggcgcugccuacggagguggcagccaucuccuucucggcaucaagcuuaccauggcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2870 - RNA, 997 nt, Artificial Sequence
  VP8* aa41-223P[4] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2871 - RNA, 997 nt, Artificial Sequence
  VP8* aa41-223P[6] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2872 - RNA, 997 nt, Artificial Sequence
  R5472/R5473 VP8* aa41-223P[8] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2873 - RNA, 997 nt, Artificial Sequence
  VP8* aa41-223P[8]-VirWa P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2874 - RNA, 997 nt, Artificial Sequence
  VP8* aa41-223P[4] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2875 - RNA, 997 nt, Artificial Sequence
  VP8* aa41-223P[6] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2876 - RNA, 997 nt, Artificial Sequence
  VP8* aa41-223P[8] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2877 - RNA, 997 nt, Artificial Sequence
  VP8* aa41-223P[8]-VirWa SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2878 - RNA, 988 nt, Artificial Sequence
  VP8* aa41-223P[4] SP(HSA) mRNA opt Design2
ggggcgcugccuacggagguggcagccaucuccuucucggcaucaagcuuaccaugaagugggugaccuucaucagccugcucuuccuguucuccagcgccuacuccgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2879 - RNA, 988 nt, Artificial Sequence
  R5433/R5594 VP8* aa41-223P[6] SP(HSA) mRNA opt Design2
ggggcgcugccuacggagguggcagccaucuccuucucggcaucaagcuuaccaugaagugggugaccuucaucagccugcucuuccuguucuccagcgccuacuccgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2880 - RNA, 988 nt, Artificial Sequence
  R5484/R5485 VP8* aa41-223P[8] SP(HSA) mRNA opt Design2
ggggcgcugccuacggagguggcagccaucuccuucucggcaucaagcuuaccaugaagugggugaccuucaucagccugcucuuccuguucuccagcgccuacuccgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2881 - RNA, 988 nt, Artificial Sequence
  VP8* aa41-223P[8]-VirWa SP(HSA) mRNA opt Design2
ggggcgcugccuacggagguggcagccaucuccuucucggcaucaagcuuaccaugaagugggugaccuucaucagccugcucuuccuguucuccagcgccuacuccgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2882 - RNA, 988 nt, Artificial Sequence
  VP8* aa41-223P[4] SP(IgE) mRNA opt Design2
ggggcgcugccuacggagguggcagccaucuccuucucggcaucaagcuuaccauggacuggaccuggauccuguuccucguggccgccgcgacccgcguccacagcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2883 - RNA, 988 nt, Artificial Sequence
  VP8* aa41-223P[6] SP(IgE) mRNA opt Design2
ggggcgcugccuacggagguggcagccaucuccuucucggcaucaagcuuaccauggacuggaccuggauccuguuccucguggccgccgcgacccgcguccacagcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2884 - RNA, 988 nt, Artificial Sequence
  VP8* aa41-223P[8] SP(IgE) mRNA opt Design2
ggggcgcugccuacggagguggcagccaucuccuucucggcaucaagcuuaccauggacuggaccuggauccuguuccucguggccgccgcgacccgcguccacagcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2885 - RNA, 988 nt, Artificial Sequence
  VP8* aa41-223P[8]-VirWa SP(IgE) mRNA opt Design2
ggggcgcugccuacggagguggcagccaucuccuucucggcaucaagcuuaccauggacuggaccuggauccuguuccucguggccgccgcgacccgcguccacagcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2886 - RNA, 1006 nt, Artificial Sequence
  VP8* aa41-223P[4] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2887 - RNA, 1006 nt, Artificial Sequence
  VP8* aa41-223P[6] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2888 - RNA, 1006 nt, Artificial Sequence
  VP8* aa41-223P[8] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2889 - RNA, 1006 nt, Artificial Sequence
  VP8* aa41-223P[8]-VirWa SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2890 - RNA, 1006 nt, Artificial Sequence
  VP8* aa41-223P[4] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2891 - RNA, 1006 nt, Artificial Sequence
  VP8* aa41-223P[6] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2892 - RNA, 1006 nt, Artificial Sequence
  VP8* aa41-223P[8] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2893 - RNA, 1006 nt, Artificial Sequence
  VP8* aa41-223P[8]-VirWa SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2894 - RNA, 1057 nt, Artificial Sequence
  VP8* aa41-223P[4] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2895 - RNA, 1057 nt, Artificial Sequence
  R5434/R5595 VP8* aa41-223P[6] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2896 - RNA, 1057 nt, Artificial Sequence
  VP8* aa41-223P[8] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2897 - RNA, 1057 nt, Artificial Sequence
  VP8* aa41-223P[8]-VirWa SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2898 - RNA, 1048 nt, Artificial Sequence
  VP8* aa41-223P[4] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2899 - RNA, 1048 nt, Artificial Sequence
  VP8* aa41-223P[6] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2900 - RNA, 1048 nt, Artificial Sequence
  R5486/R5487 VP8* aa41-223P[8] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2901 - RNA, 1048 nt, Artificial Sequence
  VP8* aa41-223P[8]-VirWa SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2902 - RNA, 1048 nt, Artificial Sequence
  VP8* aa41-223P[4] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2903 - RNA, 1048 nt, Artificial Sequence
  VP8* aa41-223P[6] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2904 - RNA, 1048 nt, Artificial Sequence
  R5488/R5489 VP8* aa41-223P[8] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2905 - RNA, 1048 nt, Artificial Sequence
  VP8* aa41-223P[8]-VirWa SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2906 - RNA, 1066 nt, Artificial Sequence
  VP8* aa41-223P[4] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2907 - RNA, 1066 nt, Artificial Sequence
  VP8* aa41-223P[6] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2908 - RNA, 1066 nt, Artificial Sequence
  VP8* aa41-223P[8] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2909 - RNA, 1066 nt, Artificial Sequence
  VP8* aa41-223P[8]-VirWa SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2910 - RNA, 1066 nt, Artificial Sequence
  VP8* aa41-223P[4] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2911 - RNA, 1066 nt, Artificial Sequence
  VP8* aa41-223P[6] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2912 - RNA, 1066 nt, Artificial Sequence
  VP8* aa41-223P[8] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2913 - RNA, 1066 nt, Artificial Sequence
  VP8* aa41-223P[8]-VirWa SP(HLA-A2)+P2Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacugggggcacggcgagaucaacgacuccaccaccguggagcccauccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2914 - RNA, 937 nt, Artificial Sequence
  VP8* aa41-223P[4] w/o glyco mRNA opt Design2
ggggcgcugccuacggagguggcagccaucuccuucucggcaucaagcuuaccauggcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2915 - RNA, 937 nt, Artificial Sequence
  VP8* aa41-223P[6] w/o glyco mRNA opt Design2
ggggcgcugccuacggagguggcagccaucuccuucucggcaucaagcuuaccauggcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2916 - RNA, 937 nt, Artificial Sequence
  VP8* aa41-223P[8] w/o glyco mRNA opt Design2
ggggcgcugccuacggagguggcagccaucuccuucucggcaucaagcuuaccauggcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2917 - RNA, 937 nt, Artificial Sequence
  VP8* aa41-223P[8]-VirWa w/o glyco mRNA opt Design2
ggggcgcugccuacggagguggcagccaucuccuucucggcaucaagcuuaccauggcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2918 - RNA, 997 nt, Artificial Sequence
  VP8* aa41-223P[4] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2919 - RNA, 997 nt, Artificial Sequence
  VP8* aa41-223P[6] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2920 - RNA, 997 nt, Artificial Sequence
  VP8* aa41-223P[8] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2921 - RNA, 997 nt, Artificial Sequence
  VP8* aa41-223P[8]-VirWa P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2922 - RNA, 997 nt, Artificial Sequence
  VP8* aa41-223P[4] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2923 - RNA, 997 nt, Artificial Sequence
  VP8* aa41-223P[6] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2924 - RNA, 997 nt, Artificial Sequence
  VP8* aa41-223P[8] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2925 - RNA, 997 nt, Artificial Sequence
  VP8* aa41-223P[8]-VirWa SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2926 - RNA, 988 nt, Artificial Sequence
  VP8* aa41-223P[4] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2927 - RNA, 988 nt, Artificial Sequence
  VP8* aa41-223P[6] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2928 - RNA, 988 nt, Artificial Sequence
  R5492/R5493 VP8* aa41-223P[8] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2929 - RNA, 988 nt, Artificial Sequence
  VP8* aa41-223P[8]-VirWa SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2930 - RNA, 988 nt, Artificial Sequence
  VP8* aa41-223P[4] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2931 - RNA, 988 nt, Artificial Sequence
  VP8* aa41-223P[6] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2932 - RNA, 988 nt, Artificial Sequence
  VP8* aa41-223P[8] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2933 - RNA, 988 nt, Artificial Sequence
  VP8* aa41-223P[8]-VirWa SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2934 - RNA, 1006 nt, Artificial Sequence
  VP8* aa41-223P[4] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2935 - RNA, 1006 nt, Artificial Sequence
  VP8* aa41-223P[6] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2936 - RNA, 1006 nt, Artificial Sequence
  VP8* aa41-223P[8] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2937 - RNA, 1006 nt, Artificial Sequence
  VP8* aa41-223P[8]-VirWa SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2938 - RNA, 1006 nt, Artificial Sequence
  VP8* aa41-223P[4] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2939 - RNA, 1006 nt, Artificial Sequence
  VP8* aa41-223P[6] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2940 - RNA, 1006 nt, Artificial Sequence
  VP8* aa41-223P[8] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2941 - RNA, 1006 nt, Artificial Sequence
  VP8* aa41-223P[8]-VirWa SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2942 - RNA, 1057 nt, Artificial Sequence
  VP8* aa41-223P[4] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2943 - RNA, 1057 nt, Artificial Sequence
  VP8* aa41-223P[6] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2944 - RNA, 1057 nt, Artificial Sequence
  VP8* aa41-223P[8] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2945 - RNA, 1057 nt, Artificial Sequence
  VP8* aa41-223P[8]-VirWa SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2946 - RNA, 1048 nt, Artificial Sequence
  VP8* aa41-223P[4] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2947 - RNA, 1048 nt, Artificial Sequence
  VP8* aa41-223P[6] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2948 - RNA, 1048 nt, Artificial Sequence
  VP8* aa41-223P[8] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2949 - RNA, 1048 nt, Artificial Sequence
  VP8* aa41-223P[8]-VirWa SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2950 - RNA, 1048 nt, Artificial Sequence
  VP8* aa41-223P[4] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2951 - RNA, 1048 nt, Artificial Sequence
  VP8* aa41-223P[6] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2952 - RNA, 1048 nt, Artificial Sequence
  VP8* aa41-223P[8] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2953 - RNA, 1048 nt, Artificial Sequence
  VP8* aa41-223P[8]-VirWa SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2954 - RNA, 1066 nt, Artificial Sequence
  VP8* aa41-223P[4] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2955 - RNA, 1066 nt, Artificial Sequence
  VP8* aa41-223P[6] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2956 - RNA, 1066 nt, Artificial Sequence
  VP8* aa41-223P[8] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2957 - RNA, 1066 nt, Artificial Sequence
  VP8* aa41-223 P[8]-VirWa SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2958 - RNA, 1066 nt, Artificial Sequence
  VP8* aa41-223P[4] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2959 - RNA, 1066 nt, Artificial Sequence
  VP8* aa41-223 P[6] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2960 - RNA, 1066 nt, Artificial Sequence
  VP8* aa41-223 P[8] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacuggggccacggggagauccaggacagcaccaccgucgagcccauccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2961 - RNA, 1066 nt, Artificial Sequence
  VP8* aa41-223P[8]-VirWa SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgcccagacccgguacgcgcccgugaacugggggcacggcgagauccaggacuccaccaccguggagcccauccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2962 - RNA, 865 nt, Artificial Sequence
  VP8* aa65-223short P[4] mRNA opt Design2
ggggcgcugccuacggagguggcagccaucuccuucucggcaucaagcuuaccaugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2963 - RNA, 865 nt, Artificial Sequence
  VP8* aa65-223short P[6] mRNA opt Design2
ggggcgcugccuacggagguggcagccaucuccuucucggcaucaagcuuaccaugcucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2964 - RNA, 865 nt, Artificial Sequence
  VP8* aa65-223 short P[8] mRNA opt Design2
ggggcgcugccuacggagguggcagccaucuccuucucggcaucaagcuuaccaugcucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2965 - RNA, 865 nt, Artificial Sequence
  VP8* aa65-223short P[8]-VirWa mRNA opt Design2
ggggcgcugccuacggagguggcagccaucuccuucucggcaucaagcuuaccaugcucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2966 - RNA, 925 nt, Artificial Sequence
  VP8* aa65-223short P[4] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2967 - RNA, 925 nt, Artificial Sequence
  VP8* aa65-223short P[6] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2968 - RNA, 925 nt, Artificial Sequence
  R5470/R5471 VP8* aa65-223 short P[8] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2969 - RNA, 925 nt, Artificial Sequence
  VP8* aa65-223short P[8]-VirWa P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2970 - RNA, 925 nt, Artificial Sequence
  VP8* aa65-223short P[4] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2971 - RNA, 925 nt, Artificial Sequence
  VP8* aa65-223short P[6] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2972 - RNA, 925 nt, Artificial Sequence
  VP8* aa65-223 short P[8] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2973 - RNA, 925 nt, Artificial Sequence
  VP8* aa65-223short P[8]-VirWa SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2974 - RNA, 916 nt, Artificial Sequence
  VP8* aa65-223short P[4] SP(HSA) mRNA opt Design2
ggggcgcugccuacggagguggcagccaucuccuucucggcaucaagcuuaccaugaagugggugaccuucaucagccugcucuuccuguucuccagcgccuacucccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2975 - RNA, 916 nt, Artificial Sequence
  VP8* aa65-223short P[6] SP(HSA) mRNA opt Design2
ggggcgcugccuacggagguggcagccaucuccuucucggcaucaagcuuaccaugaagugggugaccuucaucagccugcucuuccuguucuccagcgccuacucccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2976 - RNA, 916 nt, Artificial Sequence
  VP8* aa65-223 short P[8] SP(HSA) mRNA opt Design2
ggggcgcugccuacggagguggcagccaucuccuucucggcaucaagcuuaccaugaagugggugaccuucaucagccugcucuuccuguucuccagcgccuacucccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2977 - RNA, 916 nt, Artificial Sequence
  VP8* aa65-223short P[8]-VirWa SP(HSA) mRNA opt Design2
ggggcgcugccuacggagguggcagccaucuccuucucggcaucaagcuuaccaugaagugggugaccuucaucagccugcucuuccuguucuccagcgccuacucccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2978 - RNA, 916 nt, Artificial Sequence
  VP8* aa65-223short P[4] SP(IgE) mRNA opt Design2
ggggcgcugccuacggagguggcagccaucuccuucucggcaucaagcuuaccauggacuggaccuggauccuguuccucguggccgccgcgacccgcguccacagccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2979 - RNA, 916 nt, Artificial Sequence
  VP8* aa65-223short P[6]SP(IgE) mRNA opt Design2
ggggcgcugccuacggagguggcagccaucuccuucucggcaucaagcuuaccauggacuggaccuggauccuguuccucguggccgccgcgacccgcguccacagccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2980 - RNA, 916 nt, Artificial Sequence
  VP8* aa65-223 short P[8] SP(IgE) mRNA opt Design2
ggggcgcugccuacggagguggcagccaucuccuucucggcaucaagcuuaccauggacuggaccuggauccuguuccucguggccgccgcgacccgcguccacagccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2981 - RNA, 916 nt, Artificial Sequence
  VP8* aa65-223short P[8]-VirWa SP(IgE) mRNA opt Design2
ggggcgcugccuacggagguggcagccaucuccuucucggcaucaagcuuaccauggacuggaccuggauccuguuccucguggccgccgcgacccgcguccacagccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2982 - RNA, 934 nt, Artificial Sequence
  VP8* aa65-223short P[4] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2983 - RNA, 934 nt, Artificial Sequence
  VP8* aa65-223short P[6] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2984 - RNA, 934 nt, Artificial Sequence
  VP8* aa65-223 short P[8] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2985 - RNA, 934 nt, Artificial Sequence
  VP8* aa65-223short P[8]-VirWa SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2986 - RNA, 934 nt, Artificial Sequence
  VP8* aa65-223short P[4] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggcccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2987 - RNA, 934 nt, Artificial Sequence
  VP8* aa65-223short P[6] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggcccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2988 - RNA, 934 nt, Artificial Sequence
  VP8* aa65-223 short P[8] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggcccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2989 - RNA, 934 nt, Artificial Sequence
  VP8* aa65-223short P[8]-VirWa SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggcccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2990 - RNA, 985 nt, Artificial Sequence
  VP8* aa65-223short P[4] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2991 - RNA, 985 nt, Artificial Sequence
  VP8* aa65-223short P[6] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2992 - RNA, 985 nt, Artificial Sequence
  VP8* aa65-223 short P[8] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2993 - RNA, 985 nt, Artificial Sequence
  VP8* aa65-223short P[8]-VirWa SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2994 - RNA, 976 nt, Artificial Sequence
  VP8* aa65-223short P[4] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2995 - RNA, 976 nt, Artificial Sequence
  VP8* aa65-223short P[6] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2996 - RNA, 976 nt, Artificial Sequence
  VP8* aa65-223 short P[8] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2997 - RNA, 976 nt, Artificial Sequence
  VP8* aa65-223short P[8]-VirWa SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2998 - RNA, 976 nt, Artificial Sequence
  VP8* aa65-223short P[4] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2999 - RNA, 976 nt, Artificial Sequence
  VP8* aa65-223short P[6] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3000 - RNA, 976 nt, Artificial Sequence
  VP8* aa65-223 short P[8] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3001 - RNA, 976 nt, Artificial Sequence
  VP8* aa65-223short P[8]-VirWa SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3002 - RNA, 994 nt, Artificial Sequence
  VP8* aa65-223short P[4] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3003 - RNA, 994 nt, Artificial Sequence
  VP8* aa65-223short P[6] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3004 - RNA, 994 nt, Artificial Sequence
  VP8* aa65-223 short P[8] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3005 - RNA, 994 nt, Artificial Sequence
  VP8* aa65-223short P[8]-VirWa SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3006 - RNA, 994 nt, Artificial Sequence
  VP8* aa65-223short P[4] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3007 - RNA, 994 nt, Artificial Sequence
  VP8* aa65-223short P[6] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3008 - RNA, 994 nt, Artificial Sequence
  VP8* aa65-223 short P[8] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3009 - RNA, 994 nt, Artificial Sequence
  VP8* aa65-223short P[8]-VirWa SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3010 - RNA, 865 nt, Artificial Sequence
  VP8* aa65-223short P[4] w/o glyco mRNA opt Design2
ggggcgcugccuacggagguggcagccaucuccuucucggcaucaagcuuaccaugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3011 - RNA, 865 nt, Artificial Sequence
  VP8* aa65-223short P[6] w/o glyco mRNA opt Design2
ggggcgcugccuacggagguggcagccaucuccuucucggcaucaagcuuaccaugcucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3012 - RNA, 865 nt, Artificial Sequence
  VP8* aa65-223 short P[8] w/o glyco mRNA opt Design2
ggggcgcugccuacggagguggcagccaucuccuucucggcaucaagcuuaccaugcucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3013 - RNA, 865 nt, Artificial Sequence
  VP8* aa65-223short P[8]-VirWa w/o glyco mRNA opt Design2
ggggcgcugccuacggagguggcagccaucuccuucucggcaucaagcuuaccaugcucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3014 - RNA, 925 nt, Artificial Sequence
  VP8* aa65-223short P[4] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3015 - RNA, 925 nt, Artificial Sequence
  VP8* aa65-223short P[6] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3016 - RNA, 925 nt, Artificial Sequence
  VP8* aa65-223 short P[8] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3017 - RNA, 925 nt, Artificial Sequence
  VP8* aa65-223short P[8]-VirWa P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3018 - RNA, 925 nt, Artificial Sequence
  VP8* aa65-223short P[4] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3019 - RNA, 925 nt, Artificial Sequence
  VP8* aa65-223short P[6] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3020 - RNA, 925 nt, Artificial Sequence
  VP8* aa65-223 short P[8] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3021 - RNA, 925 nt, Artificial Sequence
  VP8* aa65-223short P[8]-VirWa SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3022 - RNA, 916 nt, Artificial Sequence
  VP8* aa65-223short P[4] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacucccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3023 - RNA, 916 nt, Artificial Sequence
  VP8* aa65-223short P[6] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacucccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3024 - RNA, 916 nt, Artificial Sequence
  VP8* aa65-223 short P[8] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacucccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3025 - RNA, 916 nt, Artificial Sequence
  VP8* aa65-223short P[8]-VirWa SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacucccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3026 - RNA, 916 nt, Artificial Sequence
  VP8* aa65-223short P[4] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3027 - RNA, 916 nt, Artificial Sequence
  VP8* aa65-223short P[6] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3028 - RNA, 916 nt, Artificial Sequence
  VP8* aa65-223 short P[8] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3029 - RNA, 916 nt, Artificial Sequence
  VP8* aa65-223short P[8]-VirWa SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3030 - RNA, 934 nt, Artificial Sequence
  VP8* aa65-223short P[4] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3031 - RNA, 934 nt, Artificial Sequence
  VP8* aa65-223short P[6] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3032 - RNA, 934 nt, Artificial Sequence
  VP8* aa65-223 short P[8] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3033 - RNA, 934 nt, Artificial Sequence
  VP8* aa65-223short P[8]-VirWa SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3034 - RNA, 934 nt, Artificial Sequence
  VP8* aa65-223short P[4] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3035 - RNA, 934 nt, Artificial Sequence
  VP8* aa65-223short P[6] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3036 - RNA, 934 nt, Artificial Sequence
  VP8* aa65-223 short P[8] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3037 - RNA, 934 nt, Artificial Sequence
  VP8* aa65-223short P[8]-VirWa SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3038 - RNA, 985 nt, Artificial Sequence
  VP8* aa65-223short P[4] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3039 - RNA, 985 nt, Artificial Sequence
  VP8* aa65-223short P[6] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3040 - RNA, 985 nt, Artificial Sequence
  VP8* aa65-223 short P[8] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3041 - RNA, 985 nt, Artificial Sequence
  VP8* aa65-223short P[8]-VirWa SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3042 - RNA, 976 nt, Artificial Sequence
  VP8* aa65-223short P[4] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3043 - RNA, 976 nt, Artificial Sequence
  VP8* aa65-223short P[6] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3044 - RNA, 976 nt, Artificial Sequence
  VP8* aa65-223 short P[8] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3045 - RNA, 976 nt, Artificial Sequence
  VP8* aa65-223short P[8]-VirWa SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3046 - RNA, 976 nt, Artificial Sequence
  VP8* aa65-223short P[4] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3047 - RNA, 976 nt, Artificial Sequence
  VP8* aa65-223short P[6] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3048 - RNA, 976 nt, Artificial Sequence
  VP8* aa65-223 short P[8] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3049 - RNA, 976 nt, Artificial Sequence
  VP8* aa65-223short P[8]-VirWa SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3050 - RNA, 994 nt, Artificial Sequence
  VP8* aa65-223short P[4] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3051 - RNA, 994 nt, Artificial Sequence
  VP8* aa65-223short P[6] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3052 - RNA, 994 nt, Artificial Sequence
  VP8* aa65-223 short P[8] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3053 - RNA, 994 nt, Artificial Sequence
  VP8* aa65-223short P[8]-VirWa SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3054 - RNA, 994 nt, Artificial Sequence
  VP8* aa65-223short P[4] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3055 - RNA, 994 nt, Artificial Sequence
  VP8* aa65-223short P[6] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3056 - RNA, 994 nt, Artificial Sequence
  VP8* aa65-223 short P[8] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3057 - RNA, 994 nt, Artificial Sequence
  VP8* aa65-223short P[8]-VirWa SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggccucgacgggcccuaccagccgacgaccuucaccccgcccaacgacuacuggauccugaucaacagcaacacccagggcgucguguacgaguccacgcagaacagcgacuucuggaccgccguggucgccaucgagccccacgugaacccgguggaccgccaguacaccaucuucggggaguccaagcaguucaacguccggcaggacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3058 - RNA, 868 nt, Artificial Sequence
  VP8* aa64-223short P[4] mRNA opt Design2
ggggcgcugccuacggagguggcagccaucuccuucucggcaucaagcuuaccauggugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3059 - RNA, 868 nt, Artificial Sequence
  VP8* aa64-223short P[6] mRNA opt Design2
ggggcgcugccuacggagguggcagccaucuccuucucggcaucaagcuuaccaugguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3060 - RNA, 928 nt, Artificial Sequence
  VP8* aa64-223short P[4] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3061 - RNA, 928 nt, Artificial Sequence
  VP8* aa64-223short P[6] P2+Linker mRNA opt Design2
ggggcgcugccuacggagguggcagccaucuccuucucggcaucaagcuuaccaugcaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3062 - RNA, 928 nt, Artificial Sequence
  VP8* aa64-223short P[4] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3063 - RNA, 928 nt, Artificial Sequence
  VP8* aa64-223short P[6] SP(TPA) mRNA opt Design2
ggggcgcugccuacggagguggcagccaucuccuucucggcaucaagcuuaccauggacgccaugaagcgcggccugugcugcgugcuccugcugugcggggccgucuucgugagcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3064 - RNA, 919 nt, Artificial Sequence
  VP8* aa64-223short P[4] SP(HSA) mRNA opt Design2
ggggcgcugccuacggagguggcagccaucuccuucucggcaucaagcuuaccaugaagugggugaccuucaucagccugcucuuccuguucuccagcgccuacuccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3065 - RNA, 919 nt, Artificial Sequence
  VP8* aa64-223short P[6] SP(HSA) mRNA opt Design2
ggggcgcugccuacggagguggcagccaucuccuucucggcaucaagcuuaccaugaagugggugaccuucaucagccugcucuuccuguucuccagcgccuacuccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3066 - RNA, 919 nt, Artificial Sequence
  VP8* aa64-223short P[4] SP(IgE) mRNA opt Design2
ggggcgcugccuacggagguggcagccaucuccuucucggcaucaagcuuaccauggacuggaccuggauccuguuccucguggccgccgcgacccgcguccacagcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3067 - RNA, 919 nt, Artificial Sequence
  VP8* aa64-223short P[6] SP(IgE) mRNA opt Design2
ggggcgcugccuacggagguggcagccaucuccuucucggcaucaagcuuaccauggacuggaccuggauccuguuccucguggccgccgcgacccgcguccacagcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3068 - RNA, 937 nt, Artificial Sequence
  VP8* aa64-223short P[4] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3069 - RNA, 937 nt, Artificial Sequence
  VP8* aa64-223short P[6] SP(CD5) mRNA opt Design2
ggggcgcugccuacggagguggcagccaucuccuucucggcaucaagcuuaccaugcccaugggcagccugcagccgcucgccacccuguaccugcucgggaugcugguggccuccugccugggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3070 - RNA, 937 nt, Artificial Sequence
  VP8* aa64-223short P[4] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3071 - RNA, 937 nt, Artificial Sequence
  VP8* aa64-223short P[6] SP(HLA-A2) mRNA opt Design2
ggggcgcugccuacggagguggcagccaucuccuucucggcaucaagcuuaccauggccgugauggccccgcggacccugguccuccugcugagcggcgcgcucgcccugacccagacgugggccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3072 - RNA, 988 nt, Artificial Sequence
  VP8* aa64-223short P[4] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3073 - RNA, 988 nt, Artificial Sequence
  VP8* aa64-223short P[6] SP(TPA)+P2+Linker mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3074 - RNA, 979 nt, Artificial Sequence
  VP8* aa64-223short P[4] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3075 - RNA, 979 nt, Artificial Sequence
  VP8* aa64-223short P[6] SP(HSA)+P2+Linker mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3076 - RNA, 979 nt, Artificial Sequence
  VP8* aa64-223short P[4] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3077 - RNA, 979 nt, Artificial Sequence
  VP8* aa64-223short P[6] SP(IgE)+P2+Linker mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3078 - RNA, 997 nt, Artificial Sequence
  VP8* aa64-223short P[4] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3079 - RNA, 997 nt, Artificial Sequence
  VP8* aa64-223short P[6] SP(CD5)+P2+Linker mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3080 - RNA, 997 nt, Artificial Sequence
  VP8* aa64-223short P[4] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3081 - RNA, 997 nt, Artificial Sequence
  VP8* aa64-223short P[6] SP(HLA-A2)+P2+Linker mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3082 - RNA, 868 nt, Artificial Sequence
  VP8* aa64-223short P[4] w/o glyco mRNA opt Design2
ggggcgcugccuacggagguggcagccaucuccuucucggcaucaagcuuaccauggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3083 - RNA, 868 nt, Artificial Sequence
  VP8* aa64-223short P[6] w/o glyco mRNA opt Design2
ggggcgcugccuacggagguggcagccaucuccuucucggcaucaagcuuaccaugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3084 - RNA, 928 nt, Artificial Sequence
  VP8* aa64-223short P[4] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

(The sequence listing continues in the following parts.)

The invention claimed is:

1. A method for stimulating an anti-rotavirus response in a patient comprising administering an effective amount of an immune stimulating composition comprising a lipid nanoparticle (LNP) comprising an mRNA molecule comprising at least one region encoding a polypeptide comprising at least 100 amino acids of a VP8* cleavage product of a rotavirus VP4 protein, wherein the mRNA comprises a 5' Cap and a poly(A) tail of 60 to about 250 adenosine at the 3' end of the mRNA, wherein the composition is administered by intramuscular injection.

2. The method of claim 1, wherein the VP8* cleavage product is derived from the P[4], P[6], or P[8] serotype.

3. The method of claim 1, wherein the mRNA molecule further comprises a sequence encoding a helper peptide and a sequence encoding a peptide linker, wherein the sequence encoding the helper peptide is located at the 5' end of the at least one region encoding at least one epitope.

4. The method of claim 3, wherein the helper peptide is derived from tetanus toxin.

5. The method of claim 1, wherein the mRNA molecule further comprises a sequence encoding a signal peptide derived from tissue plasminogen activator, albumin, CD5, HLA-A2, luciferase, immunoglobulin, or IL-2.

6. The method of claim 1, wherein the at least one region encoding at least one epitope is mutated to delete at least one predicted glycosylation site.

7. The method of claim 1, wherein the mRNA molecule further comprises a sequence encoding a transmembrane domain, wherein the sequence encoding the transmembrane domain is located at the 3' end of the at least one region encoding at least one epitope.

8. The method of claim 1, wherein the mRNA molecule further comprises a sequence encoding at least one peptide enabling virus like particle (VLP) formation, wherein the peptide is derived from Woodchuck hepatitis virus core antigen (WHcAg) or from Alfalfa mosaic virus coat protein.

9. The method of claim 1, wherein the mRNA molecule further comprises at least a second region encoding at least one epitope of a structural or non-structural protein of a different serotype of a rotavirus.

10. The method of claim 9, wherein the second region encodes a further VP8* epitope.

11. The method of claim 1, wherein the at least one region encoding the polypeptide has a G/C content of the region encoding the polypeptide that is increased compared to the G/C content of a wild type mRNA encoding the polypeptide.

12. The method of claim 1, wherein the mRNA molecule is at least partially complexed with a cationic or polycationic compound or polymeric carrier.

13. The method of claim 1, wherein the immune stimulating composition further comprises a pharmaceutical carrier.

14. The method of claim 1, wherein the immune stimulating composition further comprises at least one adjuvant component.

15. The method of claim 1, wherein the method induces a cross-reactive immune response to multiple serotypes of rotavirus.

16. The method of claim 1, wherein the 5' cap is a Cap structure is a CAP1.

17. The method of claim 4, wherein the helper peptide is the P2 helper peptide of tetanus toxin.

18. The method of claim 1, wherein the mRNA comprises a nucleotide analogue.

19. The method of claim 18, wherein the nucleotide analogue is pseudouridine or 1-methyl-pseudouridine.

20. The method of claim 1, wherein the LNP comprises an ionizable amino lipid, phospholipid, cholesterol and a PEGylated lipid.

* * * * *